US012031149B2

(12) United States Patent
Baram et al.

(10) Patent No.: US 12,031,149 B2
(45) Date of Patent: Jul. 9, 2024

(54) COMPOSITIONS AND METHODS FOR PROMOTING GENE EDITING OF CXCR4 GENE

(71) Applicant: EmendoBio Inc.

(72) Inventors: David Baram, Tel Aviv (IL); Lior Izhar, Tel Aviv (IL); Asael Herman, Ness Ziona (IL); Rafi Emmanuel, Ramla (IL); Michal Golan Mashiach, Ness Ziona (IL); Joseph Georgeson, Rehovot (IL)

(73) Assignee: EmendoBio Inc., Wilmington, DE (US)

( * ) Notice: Subject to any disclaimer, the term of this patent is extended or adjusted under 35 U.S.C. 154(b) by 671 days.

(21) Appl. No.: 16/833,119

(22) Filed: Mar. 27, 2020

(65) Prior Publication Data
US 2023/0175020 A1 Jun. 8, 2023

Related U.S. Application Data

(60) Provisional application No. 62/824,855, filed on Mar. 27, 2019.

(51) Int. Cl.
| | |
|---|---|
| *C12N 15/00* | (2006.01) |
| *A61K 48/00* | (2006.01) |
| *A61P 37/00* | (2006.01) |
| *C12N 9/22* | (2006.01) |
| *C12N 15/11* | (2006.01) |
| *C12N 15/113* | (2010.01) |
| *C12N 15/90* | (2006.01) |

(52) U.S. Cl.
CPC ............ *C12N 15/907* (2013.01); *A61K 48/00* (2013.01); *A61P 37/00* (2018.01); *C12N 9/22* (2013.01); *C12N 15/11* (2013.01); *C12N 15/111* (2013.01); *C12N 15/1136* (2013.01); *C12N 2310/20* (2017.05); *C12N 2800/80* (2013.01)

(58) Field of Classification Search
CPC ........ C12N 15/907; C12N 9/22; C12N 15/11; C12N 15/111; C12N 15/1136; C12N 2310/20; C12N 2800/80; A61P 37/00; A61K 48/00
See application file for complete search history.

(56) References Cited

U.S. PATENT DOCUMENTS

| | | | |
|---|---|---|---|
| 2015/0071889 A1* | 3/2015 | Musunuru | C12N 15/63 435/462 |
| 2016/0251667 A1* | 9/2016 | Cigan | C12N 15/113 800/279 |
| 2018/0119123 A1* | 5/2018 | Gori | C12N 9/22 |
| 2020/0377900 A1* | 12/2020 | Cargill | C12N 15/8223 |

FOREIGN PATENT DOCUMENTS

WO WO-2009100955 A1 * 8/2009 ......... C12N 15/1138

OTHER PUBLICATIONS

Cai et al in "A Universal Approach to Correct Various HBB gene Mutations in Human Stem Cells for Gene Therapy of Beta-Thalassemia and Sickle Cell Disease" (Stem Cells Translational Medicine, 2018: vol. 7: pp. 87-97). (Year: 2018).*
Vasquez et al in "Exploiting CRISPR-Cas9 technology to investigate individual histone modifications" (Nucleic Acid Research vol. 46, No. 18, published Jun. 15, 2018; pp. 1-13). (Year: 2018).*
Wegner et al.(JBC vol. 273, No. 8, Feb. 20, 1998: pp. 4754-4760). (Year: 1998).*

* cited by examiner

*Primary Examiner* — Catherine S Hibbert
(74) *Attorney, Agent, or Firm* — Jamaica P. Szeliga; Potomac Law Group, PLLC

(57) ABSTRACT

RNA molecules comprising a guide sequence portion having 17-25 contiguous nucleotides containing nucleotides in the sequence set forth in any one of SEQ ID NOs: 1-6601 and compositions, methods, and uses thereof.

12 Claims, 1 Drawing Sheet
Specification includes a Sequence Listing.

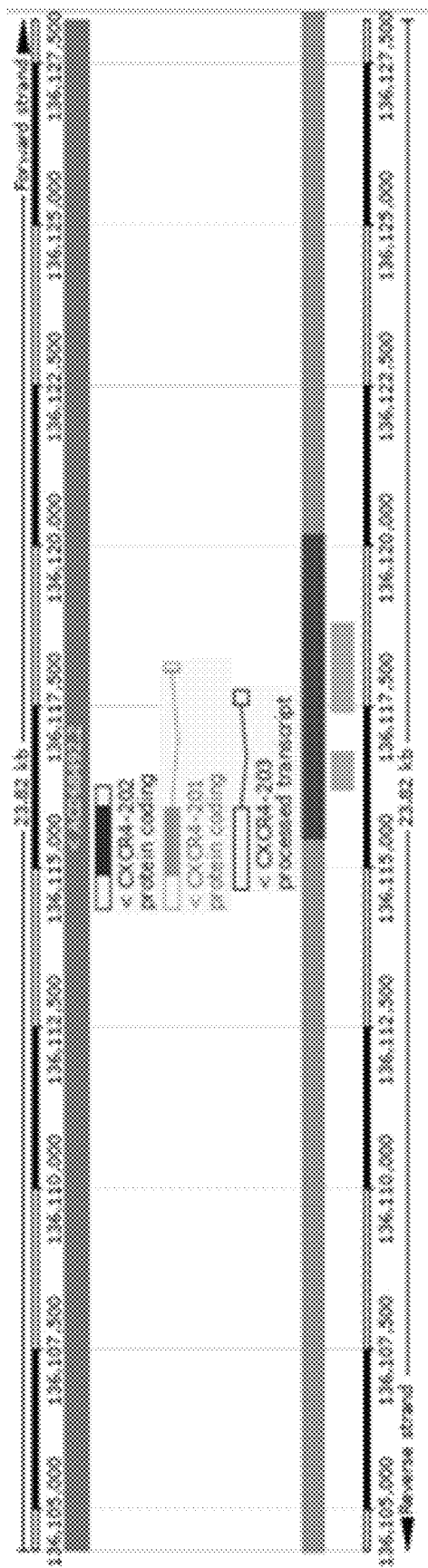

COMPOSITIONS AND METHODS FOR PROMOTING GENE EDITING OF CXCR4 GENE

This application claims the benefit of U.S. Provisional Application No. 62/824,855, filed Mar. 27, 2019, the contents of which is hereby incorporated by reference.

Throughout this application, various publications are referenced, including referenced in parenthesis. The disclosures of all publications mentioned in this application in their entireties are hereby incorporated by reference into this application in order to provide additional description of the art to which this invention pertains and of the features in the art which can be employed with this invention.

REFERENCE TO SEQUENCE LISTING

This application incorporates-by-reference nucleotide sequences which are present in the file named "200327_90919-A_Sequence_Listing_AWG.txt", which is 1,302 kilobytes in size, and which was created on Mar. 26, 2020 in the IBM-PC machine format, having an operating system compatibility with MS-Windows, which is contained in the text file filed Mar. 27, 2020 as part of this application.

BACKGROUND OF INVENTION

There are several classes of DNA variation in the human genome, including insertions and deletions, differences in the copy number of repeated sequences, and single nucleotide polymorphisms (SNPs). A SNP is a DNA sequence variation occurring when a single nucleotide (adenine (A), thymine (T), cytosine (C), or guanine (G)) in the genome differs between human subjects or paired chromosomes in an individual. Over the years, the different types of DNA variations have been the focus of the research community either as markers in studies to pinpoint traits or disease causation or as potential causes of genetic disorders.

A genetic disorder is caused by one or more abnormalities in the genome. Genetic disorders may be regarded as either "dominant" or "recessive." Recessive genetic disorders are those which require two copies (i.e., two alleles) of the abnormal/defective gene to be present. In contrast, a dominant genetic disorder involves a gene or genes which exhibit(s) dominance over a normal (functional/healthy) gene or genes. As such, in dominant genetic disorders only a single copy (i.e., allele) of an abnormal gene is required to cause or contribute to the symptoms of a particular genetic disorder. Such mutations include, for example, gain-of-function mutations in which the altered gene product possesses a new molecular function or a new pattern of gene expression. Other examples include dominant negative mutations, which have a gene product that acts antagonistically to the wild-type allele.

Warts, Hypogammaglobulinemia, Infections, and Myelokathexis (WHIM) Syndrome

WHIM syndrome is an immunodeficiency disease characterized by neutropenia, hypogammaglobulinemia, and extensive human papillomavirus (HPV) infection. Heterozygous mutations in the CXCR4 gene were demonstrated to be associated with WHIM syndrome.

SUMMARY OF THE INVENTION

Disclosed is an approach for treating/preventing/ameliorating WHIM syndrome associated with heterozygous dominant mutation of the CXCR4 gene, by utilizing an RNA guided DNA nuclease to edit/correct/modify the nucleic acid sequence of a mutant allele of the CXCR4 gene such as to express a functional protein. One approach for treating the WHIM syndrome is by differential knockout of the expression of a dominant-mutant allele ("mutant allele") by disrupting the dominant-mutant allele or degrading the resulting mRNA. Another approach is by differentially repairing the mutation in the dominant-mutant allele.

The present disclosure provides a method for utilizing at least one naturally occurring heterozygous nucleotide difference or polymorphism (e.g., single nucleotide polymorphism (SNP)) for distinguishing/discriminating between two alleles of a gene, one allele bearing a mutation such that it encodes a mutated protein causing a disease phenotype ("mutant allele"), and the other allele encoding for a functional protein ("functional allele").

As used herein, the term "heterozygous single nucleotide polymorphism" or "SNP" refers to a single nucleotide position in a genome that differs between paired chromosomes within a population. As used herein the most common or most prevalent nucleotide base at the position is referred to as the reference (REF), wild-type (WT), common, or major form. Less prevalent nucleotide bases at the position are referred to as the alternative (ALT), minor, rare, or variant forms.

Embodiments of the present invention provide methods for utilizing at least one heterozygous SNP in a gene expressing a dominant mutant allele in a given cell or subject. In embodiments of the present invention, the SNP utilized may or may not be associated with a disease phenotype. In embodiments of the present invention, an RNA molecule comprising a guide sequence targets only the mutant allele of the gene by targeting the nucleotide base present at a heterozygous SNP in the mutant allele of the gene and therefore having a different nucleotide base in the functional allele of the gene.

In some embodiments, the method further comprises the step of knocking out expression of the mutated protein and allowing expression of the functional protein. In other embodiments, the method further comprises the step of correcting/editing the mutant allele, to allow expression of the functional protein.

According to embodiments of the present invention, there is provided a first RNA molecule comprising a guide sequence portion having 17-25 contiguous nucleotides containing nucleotides in the sequence set forth in any one of SEQ ID NOs: 1-6601.

According to embodiments of the present invention, there is provided a first RNA molecule comprising a guide sequence portion having 17-25 contiguous nucleotides containing nucleotides in the sequence set forth in any one of SEQ ID NOs: 1-6601.

According to some embodiments of the present invention, there is provided a composition comprising an RNA molecule comprising a guide sequence portion having 17-25 contiguous nucleotides containing nucleotides in the sequence set forth in any one of SEQ ID NOs: 1-6601 and a CRISPR nuclease.

According to some embodiments of the present invention, there is provided a method for inactivating a mutant CXCR4 allele in a cell, the method comprises delivering to the cell a composition comprising an RNA molecule comprising a guide sequence portion having 17-25 contiguous nucleotides containing nucleotides in the sequence set forth in any one of SEQ ID NOs: 1-6601 and a CRISPR nuclease. In some embodiments, the delivering is performed within a subject's body. In some embodiment, the delivering is performed ex-vivo. In some embodiments, the cells are HSC cell originated from the subject itself.

According to some embodiments of the present invention, there is provided a method for treating CXCR4 related WHIM syndrome, the method comprising delivering to a subject having WHIM syndrome a composition comprising an RNA molecule comprising a guide sequence portion having 17-25 contiguous nucleotides containing nucleotides in the sequence set forth in any one of SEQ ID NOs: 1-6601 and a CRISPR nuclease.

According to some embodiments of the present invention, there is provided use of a composition comprising an RNA molecule comprising a guide sequence portion having 17-25 contiguous nucleotides containing nucleotides in the sequence set forth in any one of SEQ ID NOs: 1-6601 and a CRISPR nuclease for inactivating a mutant CXCR4 allele in a cell, comprising delivering to the cell the composition comprising an RNA molecule comprising a guide sequence portion 17-25 contiguous nucleotides containing nucleotides in the sequence set forth in any one of SEQ ID NOs: 1-6601 and a CRISPR nuclease.

According to embodiments of the present invention, there is provided a medicament comprising an RNA molecule comprising a guide sequence portion having 17-25 contiguous nucleotides containing nucleotides in the sequence set forth in any one of SEQ ID NOs: 1-6601 and a CRISPR nuclease for use in inactivating a mutant CXCR4 allele in a cell, wherein the medicament is administered by delivering to the cell the composition comprising an RNA molecule comprising a guide sequence portion having 17-25 contiguous nucleotides containing nucleotides in the sequence set forth in any one of SEQ ID NOs: 1-6601 and a CRISPR nuclease.

According to some embodiments of the present invention, there is provided use of a composition comprising an RNA molecule comprising a guide sequence portion having 17-25 contiguous nucleotides containing nucleotides in the sequence set forth in any one of SEQ ID NOs: 1-6601 and a CRISPR nuclease for treating ameliorating or preventing CXCR4 related WHIM syndrome, comprising delivering to a subject having or at risk of having CXCR4 related WHIM syndrome, the composition of comprising an RNA molecule comprising a guide sequence portion having 17-25 contiguous nucleotides containing nucleotides in the sequence set forth in any one of SEQ ID NOs: 1-6601 and a CRISPR nuclease.

According to some embodiments of the present invention, there is provided a medicament comprising the composition comprising an RNA molecule comprising a guide sequence portion having 17-25 contiguous nucleotides containing nucleotides in the sequence set forth in any one of SEQ ID NOs: 1-6601 and a CRISPR nuclease for use in treating ameliorating or preventing WHIM syndrome, wherein the medicament is administered by delivering to a subject having or at risk of having WHIM syndrome the composition comprising an RNA molecule comprising a guide sequence portion having 17-25 contiguous nucleotides containing nucleotides in the sequence set forth in any one of SEQ ID NOs: 1-6601 and a CRISPR nuclease.

According to some embodiments of the present invention, there is provided a kit for inactivating a mutant CXCR4 allele in a cell, comprising an RNA molecule comprising a guide sequence portion having 17-25 contiguous nucleotides containing nucleotides in the sequence set forth in any one of SEQ ID NOs: 1-6601, a CRISPR nuclease, and/or a tracrRNA molecule; and instructions for delivering the RNA molecule; CRISPR nuclease, and/or the tracrRNA to the cell. In some embodiments, the cells are HSC cells obtained from the subject and the delivery of the composition to the cell is performed ex-vivo.

According to some embodiments of the present invention, there is provided a kit for treating CXCR4 related WHIM syndrome in a subject, comprising an RNA molecule comprising a guide sequence portion having 17-25 contiguous nucleotides containing nucleotides in the sequence set forth in any one of SEQ ID NOs: 1-6601, a CRISPR nuclease, and/or a tracrRNA molecule; and instructions for delivering the RNA molecule; CRISPR nuclease, and/or the tracrRNA to a cell of subject having or at risk of having CXCR4 related WHIM syndrome.

According to some embodiments of the present invention, there are provided cells modified by the RNA molecules, compositions, or methods of the present invention.

According to some embodiments of the present invention, there are provided cells modified by the RNA molecules, compositions, or methods of the present invention for use in treating CXCR4 related WHIM syndrome in a subject having or at risk of having CXCR4 related WHIM syndrome.

According to some embodiments of the present invention, there is provided a medicament comprising the modified cells of the present invention for treating CXCR4 related WHIM syndrome in a subject having or at risk of having CXCR4 related WHIM syndrome.

According to some embodiments of the present invention, there is provided a method for inactivating a mutant allele of the CXCR4 gene in a cell, the method comprising the steps of:
  a) selecting a cell with an CXCR4 gene mutation associated with CXCR4 related WHIM syndrome and which cell is heterozygous at one or more polymorphic sites in the CXCR4 gene selected from Table 1;
  b) introducing to the cell a composition comprising:
    a CRISPR nuclease, and
    a first RNA molecule comprising a guide sequence portion having 17-25 nucleotides,
  wherein a complex of the CRISPR nuclease and the first RNA molecule affects a double strand break in only the mutant allele of the CXCR4 gene and not in the functional allele of the CXCR4 gene in the cell;
  thereby inactivating only the mutant allele of the CXCR4 gene in the cell.

In some embodiments, the cell is a stem cell. In some embodiments, the stem cell is a hematopoietic stem/progenitor cell (HSC). In some embodiments, the delivering to the cell is performed in vitro, ex vivo, or in vivo. In some embodiments, the method is performed ex vivo and the cell is provided/explanted from an individual patient. In some embodiments, the method further comprises the step of introducing the resulting cell, with the modified/knocked out mutant CXCR4 allele, into the individual patient (e.g. autologous transplantation). In some embodiments, cells are obtained from a CXCR4 related WHIM syndrome patient, using mobilization and apheresis, or using bone marrow aspiration.

According to embodiments of the present invention, there is provided a method for inactivating a mutant allele of the CXCR4 gene in a cell, the method comprising the steps of:
  a) selecting a cell with an CXCR4 gene mutation associated with a WHIM syndrome and which cell is heterozygous at one or more polymorphic sites in the CXCR4 gene selected from Table 1;

b) introducing to the cell a composition comprising:
a CRISPR nuclease, and
a first RNA molecule comprising a guide sequence portion having 17-25 nucleotides,
wherein a complex of the CRISPR nuclease and the first RNA molecule affects a double strand break in only the mutant allele of the CXCR4 gene and not in the functional allele of the CXCR4 gene in the cell;
and wherein the method further comprises introduction of a second RNA molecule comprising a guide sequence portion capable of complexing with a CRISPR nuclease, wherein the complex of second RNA molecule and the CRISPR nuclease affects a second double strand break in the CXCR4 gene;
thereby inactivating only the mutant allele of the CXCR4 gene in the cell.

In some embodiments, the cell is heterozygous at one or more polymorphic sites in the CXCR4 gene selected from: chr:2:136875458_A_C, chr2:136875456_G_C, chr2:136875452_A_C, chr2:136875448_A_C, rs11682928, rs17848385, rs17848056, rs2471859, and rs2680880, and a complex of a first RNA molecule comprising a guide sequence portion having 17-25 nucleotides and a CRISPR nuclease affects a double strand break in only the mutant allele of the CXCR4 gene and not in the functional allele of the CXCR4 gene, and wherein a complex of the second RNA molecule and the CRISPR nuclease affects a double strand break in a non-coding region such as the 3' UTR of the CXCR4 gene.

BRIEF DESCRIPTION OF THE DRAWINGS

FIG. 1: Schematic description of CXCR4 transcripts adopted from the Ensembl database.

DETAILED DESCRIPTION

Definitions

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

It should be understood that the terms "a" and "an" as used above and elsewhere herein refer to "one or more" of the enumerated components. It will be clear to one of ordinary skill in the art that the use of the singular includes the plural unless specifically stated otherwise. Therefore, the terms "a," "an" and "at least one" are used interchangeably in this application.

For purposes of better understanding the present teachings and in no way limiting the scope of the teachings, unless otherwise indicated, all numbers expressing quantities, percentages or proportions, and other numerical values used in the specification and claims, are to be understood as being modified in all instances by the term "about." Accordingly, unless indicated to the contrary, the numerical parameters set forth in the following specification and attached claims are approximations that may vary depending upon the desired properties sought to be obtained. At the very least, each numerical parameter should at least be construed in light of the number of reported significant digits and by applying ordinary rounding techniques.

Unless otherwise stated, adjectives such as "substantially" and "about" modifying a condition or relationship characteristic of a feature or features of an embodiment of the invention, are understood to mean that the condition or characteristic is defined to within tolerances that are acceptable for operation of the embodiment for an application for which it is intended. Unless otherwise indicated, the word "or" in the specification and claims is considered to be the inclusive "or" rather than the exclusive or, and indicates at least one of, or any combination of items it conjoins.

In the description and claims of the present application, each of the verbs, "comprise," "include" and "have" and conjugates thereof, are used to indicate that the object or objects of the verb are not necessarily a complete listing of components, elements or parts of the subject or subjects of the verb. Other terms as used herein are meant to be defined by their well-known meanings in the art.

The terms "nucleic acid template" and "donor", refer to a nucleotide sequence that is inserted or copied into a genome. The nucleic acid template comprises a nucleotide sequence, e.g., of one or more nucleotides, that will be added to or will template a change in the target nucleic acid or may be used to modify the target sequence. A nucleic acid template sequence may be of any length, for example between 2 and 10,000 nucleotides in length, preferably between about 100 and 1,000 nucleotides in length, more preferably between about 200 and 500 nucleotides in length. A nucleic acid template may be a single stranded nucleic acid, a double stranded nucleic acid. In some embodiments, the nucleic acid template comprises a nucleotide sequence, e.g., of one or more nucleotides, that corresponds to wild type sequence of the target nucleic acid, e.g., of the target position. In some embodiments, the nucleic acid template comprises a nucleotide sequence, e.g., of one or more ribonucleotides, that corresponds to wild type sequence of the target nucleic acid, e.g., of the target position. In some embodiments, the nucleic acid template comprises modified nucleotides.

In some embodiments of the present invention, a DNA nuclease is utilized to affect a DNA break at a target site to induce cellular repair mechanisms, for example, but not limited to, non-homologous end-joining (NHEJ) or homology-directed repair (HDR). During classical NHEJ, two ends of a double-strand break (DSB) site are ligated together in a fast but also inaccurate manner (i.e. frequently resulting in mutation of the DNA at the cleavage site in the form of small insertion or deletions) whereas during HDR, an intact homologous DNA donor is used to replace the DNA surrounding the cleavage site in an accurate manner. HDR can also mediate the precise insertion of exogenous DNA at the break site. Accordingly, the term "homology-directed repair" or "HDR" refers to a mechanism for repairing DNA damage in cells, for example, during repair of double-stranded and single-stranded breaks in DNA. HDR requires nucleotide sequence homology and uses a "nucleic acid template" (nucleic acid template or donor template used interchangeably herein) to repair the sequence where the double-stranded or single break occurred (e.g., DNA target sequence). This results in the transfer of genetic information from, for example, the nucleic acid template to the DNA target sequence. HDR may result in alteration of the DNA target sequence (e.g., insertion, deletion, mutation) if the nucleic acid template sequence differs from the DNA target sequence and part or all of the nucleic acid template polynucleotide or oligonucleotide is incorporated into the DNA target sequence. In some embodiments, an entire nucleic acid template polynucleotide, a portion of the nucleic acid template polynucleotide, or a copy of the nucleic acid template is integrated at the site of the DNA target sequence.

Insertion of an exogenous sequence (also called a "donor sequence," donor template," "donor molecule" or "donor"), for example, for correction of a mutant gene or for increased expression of a wild-type gene can also be carried out. It will be readily apparent that the donor sequence is typically not identical to the genomic sequence where it is placed. A donor sequence can contain a non-homologous sequence flanked by two regions of homology to allow for efficient HDR at the location of interest. Additionally, donor sequences can comprise a vector molecule containing sequences that are not homologous to the region of interest in cellular chromatin. A donor molecule can contain several, discontinuous regions of homology to cellular chromatin. For example, for targeted insertion of sequences not normally present in a region of interest, said sequences can be present in a donor nucleic acid molecule and flanked by regions of homology to sequence in the region of interest. A donor molecule may be any length, for example ranging from several bases e.g. 10-20 bases to multiple kilobases in length.

The donor polynucleotide can be DNA or RNA, single-stranded and/or double-stranded and can be introduced into a cell in linear or circular form. See, e.g., U.S. Patent Publication Nos. 2010/0047805; 2011/0281361; 2011/0207221; and 2019/0330620. If introduced in linear form, the ends of the donor sequence can be protected (e.g., from exonucleolytic degradation) by methods known to those of skill in the art. For example, one or more dideoxynucleotide residues are added to the 3' terminus of a linear molecule and/or self-complementary oligonucleotides are ligated to one or both ends. See, for example, Chang et al. (1987) Proc. Natl. Acad. Sci. USA 84:4959-4963; Nehls et al. (1996) Science 272:886-889. Additional methods for protecting exogenous polynucleotides from degradation include, but are not limited to, addition of terminal amino group(s) and the use of modified internucleotide linkages such as, for example, phosphorothioates, phosphoramidates, and O-methyl ribose or deoxyribose residues.

Accordingly, embodiments of the present invention using a donor template for HDR may be DNA or RNA, single-stranded and/or double-stranded and can be introduced into a cell in linear or circular form. In embodiments of the present invention using: (1) a nuclease associated with an RNA molecule comprising a guide sequence to affect a double strand break in a gene prior to HDR and (2) a donor template for HDR.

A donor sequence may also be an oligonucleotide and be used for gene correction or targeted alteration of an endogenous sequence. The oligonucleotide may be introduced to the cell on a vector, may be electroporated into the cell, or may be introduced via other methods known in the art. The oligonucleotide can be used to ʻcorrect' a mutated sequence in an endogenous gene (e.g., the sickle mutation in beta globin), or may be used to insert sequences with a desired purpose into an endogenous locus (e.g. a splice acceptor sequence).

A polynucleotide can be introduced into a cell as part of a vector molecule having additional sequences such as, for example, replication origins, promoters and genes encoding antibiotic resistance. Moreover, donor polynucleotides can be introduced as naked nucleic acid, as nucleic acid complexed with an agent such as a liposome or poloxamer, or can be delivered by viruses (e.g., adenovirus, AAV, herpesvirus, retrovirus, lentivirus and integrase defective lentivirus (IDLV)).

The donor is may be inserted so that its expression is driven by the endogenous promoter at the integration site, namely the promoter that drives expression of the endogenous gene into which the donor is inserted. However, it will be apparent that the donor may comprise a promoter and/or enhancer, for example a constitutive promoter or an inducible or tissue specific promoter.

The donor molecule may be inserted into an endogenous gene such that all, some or none of the endogenous gene is expressed. For example, a transgene as described herein may be inserted into an endogenous locus such that some (N-terminal and/or C-terminal to the transgene) or none of the endogenous sequences are expressed, for example as a fusion with the transgene. In other embodiments, a transgene (e.g., with or without additional coding sequences such as for the endogenous gene) is integrated into any endogenous locus, for example a safe-harbor locus, for example a CCR5 gene, a CXCR4 gene, a PPP1R12c (also known as AAVS1) gene, an albumin gene or a Rosa gene. See, e.g., U.S. Pat. Nos. 7,951,925 and 8,110,379; U.S. Publication Nos. 2008/0159996; 2010/00218264; 2010/0291048; 2012/0017290; 2011/0265198; 2013/0137104; 2013/0122591; 2013/0177983 and 2013/0177960 and U.S. Provisional Application No. 61/823,689).

When endogenous sequences (endogenous or part of the transgene) are expressed with the transgene, the endogenous sequences may be full-length sequences (wild-type or mutant) or partial sequences. Preferably the endogenous sequences are functional. Non-limiting examples of the function of these full length or partial sequences include increasing the serum half-life of the polypeptide expressed by the transgene (e.g., therapeutic gene) and/or acting as a carrier.

Furthermore, although not required for expression, exogenous sequences may also include transcriptional or translational regulatory sequences, for example, promoters, enhancers, insulators, internal ribosome entry sites, sequences encoding 2A peptides and/or polyadenylation signals.

In certain embodiments, the donor molecule comprises a sequence selected from the group consisting of a gene encoding a protein (e.g., a coding sequence encoding a protein that is lacking in the cell or in the individual or an alternate version of a gene encoding a protein), a regulatory sequence and/or a sequence that encodes a structural nucleic acid such as a microRNA or siRNA.

As used herein, the term "modified cells" refers to cells in which a double strand break is affected by a complex of an RNA molecule and the CRISPR nuclease as a result of hybridization with the target sequence, i.e. on-target hybridization. The term "modified cells" may further encompass cells in which a repair or correction of a mutation was affected following the double strand break.

This invention provides a modified cell or cells obtained by use of any of the methods described herein. In an embodiment these modified cell or cells are capable of giving rise to progeny cells. In an embodiment these modified cell or cells are capable of giving rise to progeny cells after engraftment. As a non-limiting example, the modified cells may be hematopoietic stem cell (HSC), or any cell suitable for an allogenic cell transplant or autologous cell transplant.

This invention also provides a composition comprising these modified cells and a pharmaceutically acceptable carrier. Also provided is an in vitro or ex vivo method of preparing this, comprising mixing the cells with the pharmaceutically acceptable carrier.

As used herein, the term "targeting sequence" or "targeting molecule" refers a nucleotide sequence or molecule comprising a nucleotide sequence that is capable of hybridizing to a specific target sequence, e.g., the targeting sequence has a nucleotide sequence which is at least partially complementary to the sequence being targeted along the length of the targeting sequence. The targeting sequence or targeting molecule may be part of an RNA molecule that can form a complex with a CRISPR nuclease with the targeting sequence serving as the targeting portion of the CRISPR complex. When the molecule having the targeting sequence is present contemporaneously with the CRISPR molecule the RNA molecule is capable of targeting the CRISPR nuclease to the specific target sequence. Each possibility represents a separate embodiment. An RNA molecule can be custom designed to target any desired sequence.

The term "targets" as used herein, refers to a targeting sequence or targeting molecule's preferential hybridization to a nucleic acid having a targeted nucleotide sequence. It is understood that the term "targets" encompasses variable hybridization efficiencies, such that there is preferential targeting of the nucleic acid having the targeted nucleotide sequence, but unintentional off-target hybridization in addition to on-target hybridization might also occur. It is understood that where an RNA molecule targets a sequence, a complex of the RNA molecule and a CRISPR nuclease molecule targets the sequence for nuclease activity.

The "guide sequence portion" of an RNA molecule refers to a nucleotide sequence that is capable of hybridizing to a specific target DNA sequence, e.g., the guide sequence portion has a nucleotide sequence which is fully complementary to the DNA sequence being targeted along the length of the guide sequence portion. In some embodiments, the guide sequence portion is 17, 18, 19, 20, 21, 22, 23, 24, or 25 nucleotides in length, or approximately 17-25, 17-24, 17-22, 17-21, 18-25, 18-24, 18-23, 18-22, 18-21, 19-25, 19-24, 19-23, 19-22, 19-21, 19-20, 20-22, 18-20, 20-21, 21-22, or 17-20 nucleotides in length. The entire length of the guide sequence portion is fully complementary to the DNA sequence being targeted along the length of the guide sequence portion. The guide sequence portion may be part of an RNA molecule that can form a complex with a CRISPR nuclease with the guide sequence portion serving as the DNA targeting portion of the CRISPR complex. When the DNA molecule having the guide sequence portion is present contemporaneously with the CRISPR molecule the RNA molecule is capable of targeting the CRISPR nuclease to the specific target DNA sequence. Each possibility represents a separate embodiment. An RNA molecule can be custom designed to target any desired sequence.

The term "non-discriminatory" as used herein refers to a guide sequence portion of an RNA molecule that targets a specific DNA sequence that is common both a mutant and functional allele of a gene.

In embodiments of the present invention, an RNA molecule comprises a guide sequence portion having 17-25 contiguous nucleotides containing nucleotides in the sequence set forth in any one of SEQ ID NOs: 1-6601. It is understood that in any of the embodiments of the present invention the guide sequence portion of an RNA molecule may comprise 17-25 contiguous nucleotides containing nucleotides in the sequence set forth in any one of SEQ ID NOs: 1-6601.

The RNA molecule and or the guide sequence portion of the RNA molecule may contain modified nucleotides. Exemplary modifications to nucleotides/polynucleotides may be synthetic and encompass polynucleotides which contain nucleotides comprising bases other than the naturally occurring adenine, cytosine, thymine, uracil, or guanine bases. Modifications to polynucleotides include polynucleotides which contain synthetic, non-naturally occurring nucleosides e.g., locked nucleic acids. Modifications to polynucleotides may be utilized to increase or decrease stability of an RNA. An example of a modified polynucleotide is an mRNA containing 1-methyl pseudouridine. For examples of modified polynucleotides and their uses, see U.S. Pat. No. 8,278,036, PCT International Publication No. WO/2015/006747, and Weissman and Kariko (2015), hereby incorporated by reference.

As used herein, "contiguous nucleotides" set forth in a SEQ ID NO refers to nucleotides in a sequence of nucleotides in the order set forth in the SEQ ID NO without any intervening nucleotides.

In embodiments of the present invention, the guide sequence portion may be 25 nucleotides in length and contain 20-22 nucleotides in the sequence set forth in any one of SEQ ID NOs: 1-6601. In embodiments of the present invention, the guide sequence portion may be less than 22 nucleotides in length. For example, in embodiments of the present invention the guide sequence portion may be 17, 18, 19, 20, or 21 nucleotides in length. In such embodiments the guide sequence portion may consist of 17, 18, 19, 20, or 21 nucleotides, respectively, in the sequence of 17-22 contiguous nucleotides set forth in any one of SEQ ID NOs: 1-6602. For example, a guide sequence portion having 17 nucleotides in the sequence of 17 contiguous nucleotides set forth in SEQ ID NO: 6602 may consist of any one of the following nucleotide sequences (nucleotides excluded from the contiguous sequence are marked in strike-through):

```
                                    (SEQ ID NO: 6602)
AAGCAUUAACCCAGUUAAAA 17 nucleotide guide sequence 1:
                                    (SEQ ID NO: 6603)
A̶A̶G̶CAUUAACCCAGUUAAAA 17 nucleotide guide sequence 2:
                                    (SEQ ID NO: 6604)
A̶A̶GCAUUAACCCAGUUAAA̶A̶

17 nucleotide guide sequence 3:
                                    (SEQ ID NO: 6605)
A̶AGCAUUAACCCAGUUAA̶A̶A̶

17 nucleotide guide sequence 4:
                                    (SEQ ID NO: 6606)
AAGCAUUAACCCAGUUA̶A̶A̶A̶
```

In embodiments of the present invention, the guide sequence portion may be greater than 20 nucleotides in length. For example, in embodiments of the present invention the guide sequence portion may be 21, 22, 23, 24 or 25 nucleotides in length. In such embodiments the guide sequence portion comprises 17-25 nucleotides in the sequence of 20, 21, or 22 contiguous nucleotides set forth in any one of SEQ ID NOs: 1-6601 and additional nucleotides fully complimentary to a nucleotide or sequence of nucleotides adjacent to the 3' end of the target sequence, 5' end of the target sequence, or both.

In embodiments of the present invention, a CRISPR nuclease and an RNA molecule comprising a guide sequence portion form a CRISPR complex that binds to a target DNA sequence to effect cleavage of the target DNA sequence. CRISPR nucleases, e.g. Cpf1, may form a CRISPR complex comprising a CRISPR nuclease and RNA molecule without a further tracrRNA molecule. Alternatively, CRISPR nucleases, e.g. Cas9, may form a CRISPR complex between the CRISPR nuclease, an RNA molecule, and a tracrRNA molecule.

In embodiments of the present invention, the RNA molecule may further comprise the sequence of a tracrRNA molecule. Such embodiments may be designed as a synthetic fusion of the guide portion of the RNA molecule and the trans-activating crRNA (tracrRNA). (See Jinek et al. Science (2012)). Embodiments of the present invention may also form CRISPR complexes utilizing a separate tracrRNA molecule and a separate RNA molecule comprising a guide sequence portion. In such embodiments the tracrRNA molecule may hybridize with the RNA molecule via base pairing and may be advantageous in certain applications of the invention described herein.

The term "tracr mate sequence" refers to a sequence sufficiently complementary to a tracrRNA molecule so as to hybridize to the tracrRNA via basepairing and promote the formation of a CRISPR complex. (See U.S. Pat. No. 8,906,616). In embodiments of the present invention, the RNA molecule may further comprise a portion having a tracr mate sequence.

A "gene," for the purposes of the present disclosure, includes a DNA region encoding a gene product, as well as all DNA regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions.

"Eukaryotic" cells include, but are not limited to, fungal cells (such as yeast), plant cells, animal cells, mammalian cells and human cells.

The term "nuclease" as used herein refers to an enzyme capable of cleaving the phosphodiester bonds between the nucleotide subunits of nucleic acid. A nuclease may be isolated or derived from a natural source. The natural source may be any living organism. Alternatively, a nuclease may be a modified or a synthetic protein which retains the phosphodiester bond cleaving activity. Gene modification can be achieved using a nuclease, for example a CRISPR nuclease.

As used herein, the term HSC refers to both hematopoietic stem cells and hematopoietic stem progenitor cells. Non-limiting examples of stem cells include bone marrow cells, myeloid progenitor cells, a multipotent progenitor cells, a lineage restricted progenitor cells.

As used herein, "progenitor cell" refers to a lineage cell that is derived from stem cell and retains mitotic capacity and multipotency (e.g., can differentiate or develop into more than one but not all types of mature lineage of cell). As used herein "hematopoiesis" or "haemopoiesis" refers to the formation and development of various types of blood cells (e.g., red blood cells, megakaryocytes, myeloid cells (e.g., monocytes, macrophages and neutrophil), and lymphocytes) and other formed elements in the body (e.g., in the bone marrow).

The term "single nucleotide polymorphism (SNP) position", as used herein, refers to a position in which a single nucleotide DNA sequence variation occurs between members of a species, or between paired chromosomes in an individual. In the case that a SNP position exists at paired chromosomes in an individual, a SNP on one of the chromosomes is a "heterozygous SNP." The term SNP position refers to the particular nucleic acid position where a specific variation occurs and encompasses both a sequence including the variation from the most frequently occurring base at the particular nucleic acid position (also referred to as "SNP" or alternative "ALT") and a sequence including the most frequently occurring base at the particular nucleic acid position (also referred to as reference, or "REF"). Accordingly, the sequence of a SNP position may reflect a SNP (i.e. an alternative sequence variant relative to a consensus reference sequence within a population), or the reference sequence itself.

A skilled artisan will appreciate that in all of the embodiments of the present invention, each of the RNA molecules of the present invention are capable of complexing with a CRISPR nuclease such as to associate with a target genomic DNA sequence of interest next to a protospacer adjacent motif (PAM). The CRISPR nuclease then mediates cleavage of target DNA to create a double-stranded break within the protospacer. Accordingly, in embodiments of the present invention, the guide sequences and RNA molecules of the present invention may target a location 1, 2, 3, 4, 5, 6, 7, 8, 9, 10, 11, 12, 13, 14, 15, 16, 17, 18, 19, 20, 21, 22, 23, 24, 25, 26, 27, or 28 nucleotides upstream or downstream from a PAM site In embodiments of the present invention, the guide sequences and RNA molecules of the present invention may target a location that is within the PAM site.

Therefore, in embodiments of the present invention, the RNA molecules of the present invention may affect a double strand break in an allele of a gene 1, 2, 3, 4, 5, 6, 7, 8, 9, 10, 11, 12, 13, 14, 15, 16, 17, 18, 19, 20, 21, 22, 23, 24, 25, 26, 27, 28 upstream or downstream from a polymorphic site. In further embodiments of the invention, the polymorphic site is within the PAM site. A skilled artisan will appreciate that where a heterozygous polymorphic site is present, an RNA molecule may be designed to affect a double stranded break in only the REF or ALT nucleotide base of the heterozygous polymorphic site.

In embodiments of the present invention, an RNA molecule is designed to target a heterozygous polymorphic site present in the CXCR4 gene, wherein the RNA molecule targets only the nucleotide base, REF or ALT, of the heterozygous polymorphic site present in only the mutant allele of the CXCR4 gene Embodiments The present disclosure provides a method for utilizing at least one naturally occurring nucleotide difference or polymorphism (e.g., single nucleotide polymorphism (SNP)) for distinguishing/discriminating between two alleles of a gene, one allele bearing a mutation such that it encodes a mutated protein causing a disease phenotype ("mutant allele"), and the other allele encoding for a functional protein ("functional allele"). The method further comprises the step of knocking out expression of the mutated protein and allowing expression of the functional protein. In some embodiments, the method is for treating, ameliorating, or preventing a dominant negative genetic disorder.

Embodiments of the present invention provide methods for utilizing at least one heterozygous SNP in a gene expressing a dominant mutant allele in a given cell or subject. In embodiments of the present invention, the SNP utilized may or may not be associated with a disease phenotype. In embodiments of the present invention, an RNA molecule comprising a guide sequence targets only the mutant allele of the gene by targeting the nucleotide base present at a heterozygous SNP in the mutant allele of the gene and therefore having a different nucleotide base in the functional allele of the gene.

According to embodiments of the present invention, there is provided a first RNA molecule comprising a guide sequence portion having 17-25 contiguous nucleotides containing nucleotides in the sequence set forth in any one of SEQ ID NOs: 1-6601.

According to embodiments of the present invention, there is provided a first RNA molecule comprising a guide sequence portion having 17-25 contiguous nucleotides containing nucleotides in the sequence set forth in any one of SEQ ID NOs: 1-6601.

According to embodiments of the present invention, an RNA molecule may further comprise a portion having a sequence which binds to a CRISPR nuclease.

According to embodiments of the present invention, the sequence which binds to a CRISPR nuclease is a tracrRNA sequence.

According to embodiments of the present invention, an RNA molecule may further comprise a portion having a tracr mate sequence.

According to embodiments of the present invention, an RNA molecule may further comprise one or more linker portions.

According to embodiments of the present invention, an RNA molecule may be up to 300, 290, 280, 270, 260, 250, 240, 230, 220, 210, 200, 190, 180, 170, 160, 150, 140, 130, 120, 110, or 100 nucleotides in length. Each possibility represents a separate embodiment. In embodiments of the present invention, the RNA molecule may be 17 up to 300 nucleotides in length, 100 up to 300 nucleotides in length, 150 up to 300 nucleotides in length, 200 up to 300 nucleotides in length, 100 to 200 nucleotides in length, or 150 up to 250 nucleotides in length. Each possibility represents a separate embodiment.

According to some embodiments of the present invention, there is provided a composition comprising an RNA molecule comprising a guide sequence portion having 17-25 contiguous nucleotides containing nucleotides in the sequence set forth in any one of SEQ ID NOs: 1-6601 and a CRISPR nuclease.

According to embodiments of the present invention, the composition may comprise a second RNA molecule comprising a guide sequence portion.

According to embodiments of the present invention, the guide sequence portion of the second RNA molecule comprises 17-25 contiguous nucleotides containing nucleotides in the sequence set forth in any one of SEQ ID NOs: 1-6601.

According to embodiments of the present invention, the 17-25 nucleotides of the guide sequence portion of the second RNA molecule are in a different sequence from the sequence of the guide sequence portion of the first RNA molecule.

According to embodiments of the present invention, the 17-25 nucleotides of the guide sequence portion of the second RNA molecule, when complexed with a CRISPR nuclease, target a non-coding region of the CXCR4 gene. In some embodiments, the non-coding region is the 3' UTR.

Embodiments of the present invention may comprise a tracrRNA molecule.

According to some embodiments of the present invention, there is provided a method for inactivating a mutant CXCR4 allele in a cell, the method comprising delivering to the cell a composition comprising an RNA molecule comprising a guide sequence portion having 17-25 contiguous nucleotides containing nucleotides in the sequence set forth in any one of SEQ ID NOs: 1-6601 and a CRISPR nuclease.

According to some embodiments of the present invention, there is provided a method for treating CXCR4 related WHIM syndrome, the method comprising delivering to a cell of a subject having CXCR4 related WHIM syndrome a composition comprising an RNA molecule comprising a guide sequence portion having 17-25 contiguous nucleotides containing nucleotides in the sequence set forth in any one of SEQ ID NOs: 1-6601 and a CRISPR nuclease.

According to embodiments of the present invention, the composition comprises a second RNA molecule comprising a guide sequence portion having 17-25 contiguous nucleotides containing nucleotides in the sequence set forth in any one of SEQ ID NOs: 1-6601.

According to embodiments of the present invention, the 17-25 nucleotides of the guide sequence portion of the second RNA molecule are in a different sequence from the sequence of the guide sequence portion of the first RNA molecule According to embodiments of the present invention, the CRISPR nuclease and the RNA molecule or RNA molecules are delivered to the subject and/or cells substantially at the same time or at different times.

According to embodiments of the present invention, the tracrRNA is delivered to the subject and/or cells substantially at the same time or at different times as the CRISPR nuclease and RNA molecule or RNA molecules.

According to embodiments of the present invention, the first RNA molecule targets a first heterozygous SNP present in an exon or promoter of the CXCR4 gene wherein the first RNA molecule targets the nucleotide base, REF or ALT, of the first SNP present in only the mutant allele of the CXCR4 gene, and wherein the second RNA molecule targets a sequence in a non-coding region present in both the mutant or functional allele of the CXCR4 gene.

According to embodiments of the present invention, there is provided a method comprising removing an exon containing a disease-causing mutation from a mutant allele, wherein the first RNA molecule or the first and the second RNA molecules target regions flanking an entire exon or a portion of the exon.

According to embodiments of the present invention, there is provided a method comprising removing multiple exons, the entire open reading frame of a gene, or removing the entire gene.

According to embodiments of the present invention, the first RNA molecule targets a first heterozygous SNP present in an exon or promoter of the CXCR4 gene, and wherein the second RNA molecule targets a second heterozygous SNP present in the same or a different exon or in an intron of the CXCR4 gene wherein the second RNA molecule targets the nucleotide base, REF or ALT, of the second SNP present in only the mutant allele of the CXCR4 gene, or the second RNA molecule targets a sequence in an intron present in both the mutant and functional allele of the CXCR4 gene.

According to embodiments of the present invention, the first RNA molecule or the first and the second RNA molecules target an alternative splicing signal sequence between an exon and an intron of a mutant allele.

According to embodiments of the present invention, the second RNA molecule targets a sequence present in both a mutant allele and a functional allele of the CXCR4 gene.

According to embodiments of the present invention, the second RNA molecule targets an intron. According to embodiments of the present invention, the second RNA molecule targets the 3' UTR.

According to embodiments of the present invention, there is provided a method comprising subjecting the mutant allele to insertion or deletion by an error prone non-homologous end joining (NHEJ) mechanism, generating a frameshift in the mutant allele's sequence.

According to embodiments of the present invention, the frameshift results in inactivation or knockout of the mutant allele.

According to embodiments of the present invention, the frameshift creates an early stop codon in the mutant allele.

According to embodiments of the present invention, the frameshift results in nonsense-mediated mRNA decay of the transcript of the mutant allele.

According to embodiments of the present invention, the inactivating or treating results in a truncated protein encoded by the mutant allele and a functional protein encoded by the functional allele.

According to some embodiments of the present invention, there is provided use of a composition comprising an RNA molecule comprising a guide sequence portion having 17-25 contiguous nucleotides containing nucleotides in the sequence set forth in any one of SEQ ID NOs: 1-6601 and a CRISPR nuclease inactivating a mutant CXCR4 allele in a cell, comprising delivering to the cell the RNA molecule comprising a guide sequence portion having 17-25 contiguous nucleotides containing nucleotides in the sequence set forth in any one of SEQ ID NOs: 1-6601 and the CRISPR nuclease.

According to embodiments of the present invention, there is provided a medicament comprising an RNA molecule comprising a guide sequence portion 17-25 contiguous nucleotides containing nucleotides in the sequence set forth in any one of SEQ ID NOs: 1-6601 and a CRISPR nuclease for use in inactivating a mutant CXCR4 allele in a cell, wherein the medicament is administered by delivering to the cell the composition comprising an RNA molecule comprising a guide sequence portion having 17-25 contiguous nucleotides containing nucleotides in the sequence set forth in any one of SEQ ID NOs: 1-6601 and a CRISPR nuclease.

According to some embodiments of the present invention, there is provided use of a composition comprising an RNA molecule comprising a guide sequence portion having 17-25 contiguous nucleotides containing nucleotides in the sequence set forth in any one of SEQ ID NOs: 1-6601 and a CRISPR nuclease for treating ameliorating or preventing WHIM, comprising delivering to a subject having or at risk of having WHIM the composition of comprising an RNA molecule comprising a guide sequence portion having 17-25 contiguous nucleotides containing nucleotides in the sequence set forth in any one of SEQ ID NOs: 1-6601 and a CRISPR nuclease.

According to some embodiments of the present invention, there is provided a medicament comprising the composition comprising an RNA molecule comprising a guide sequence portion having 17-25 contiguous nucleotides containing nucleotides in the sequence set forth in any one of SEQ ID NOs: 1-6601 and a CRISPR nuclease for use in treating ameliorating or preventing WHIM syndrome, wherein the medicament is administered by delivering to a subject having or at risk of having WHIM syndrome: the composition comprising an RNA molecule comprising a guide sequence portion having 17-25 contiguous nucleotides containing nucleotides in the sequence set forth in any one of SEQ ID NOs: 1-6601 and a CRISPR nuclease.

According to some embodiments of the present invention, there is provided a kit for inactivating a mutant CXCR4 allele in a cell, comprising an RNA molecule comprising a guide sequence portion having 17-25 contiguous nucleotides containing nucleotides in the sequence set forth in any one of SEQ ID NOs: 1-6601, a CRISPR nuclease, and/or a tracrRNA molecule; and instructions for delivering the RNA molecule; CRISPR nuclease, and/or the tracrRNA to the cell.

According to some embodiments of the present invention, there is provided a kit for treating WHIM syndrome in a subject, comprising an RNA molecule comprising a guide sequence portion having 17-25 contiguous nucleotides containing nucleotides in the sequence set forth in any one of SEQ ID NOs: 1-6601, a CRISPR nuclease, and/or a tracrRNA molecule; and instructions for delivering the RNA molecule; CRISPR nuclease, and/or the tracrRNA to a subject having or at risk of having WHIM syndrome.

The compositions and methods of the present disclosure may be utilized for treating, preventing, ameliorating, or slowing progression of WHIM syndrome.

In some embodiments, the method of deactivating a mutant allele comprises an exon skipping step comprising removing an exon containing a disease-causing mutation from the mutant allele. Removing an exon containing a disease-causing mutation in the mutant allele requires two RNA molecules which target regions flanking the entire exon or a portion of the exon. Removal of an exon containing the disease-causing mutation may be designed to eliminate the disease-causing action of the protein while allowing for expression of the remaining protein product which retains some or all of the wild-type activity. As an alternative to single exon skipping, multiple exons, the entire open reading frame or the entire gene can be excised using two RNA molecules flanking the region desired to be excised.

In some embodiments, the method of deactivating a mutant allele comprises delivering two RNA molecules to a cell, wherein one RNA molecule targets a first heterozygous SNP present in an exon or promoter of the CXCR4 gene wherein the RNA molecule targets the nucleotide base, REF or ALT, of the first SNP present in only the mutant allele of the CXCR4 gene, and wherein the other RNA molecule targets a second heterozygous SNP present in the same or a different exon or in an intron of the CXCR4 gene wherein the RNA molecule targets the nucleotide base, REF or ALT, of the second SNP present in only the mutant allele of the CXCR4 gene, or the second RNA molecule targets a sequence in an intron present in both the mutant or functional allele.

In some embodiments, an RNA molecule is used to target a CRISPR nuclease to an alternative splicing signal sequence between an exon and an intron of a mutant allele, thereby destroying the alternative splicing signal sequence in the mutant allele.

Any one of, or combination of, the above-mentioned strategies for deactivating a mutant allele may be used in the context of the invention.

Additional strategies may be used to deactivate a mutant allele. For example, in embodiments of the present invention, an RNA molecule is used to direct a CRISPR nuclease to an exon or a splice site of a mutant allele in order to create a double-stranded break (DSB), leading to insertion or deletion of nucleotides by an error-prone non-homologous end-joining (NHEJ) mechanism and formation of a frameshift mutation in the mutant allele. The frameshift mutation may result in: (1) inactivation or knockout of the mutant allele by generation of an early stop codon in the mutant allele, resulting in generation of a truncated protein; or (2) nonsense mediated mRNA decay of the transcript of the mutant allele. In further embodiments, one RNA molecule is used to direct a CRISPR nuclease to a promotor of a mutant allele.

In some embodiments, the method of deactivating a mutant allele further comprises enhancing activity of the functional protein such as by providing a protein/peptide, a nucleic acid encoding a protein/peptide, or a small molecule such as a chemical compound, capable of activating/enhancing activity of the functional protein.

According to some embodiments, the present disclosure provides an RNA molecule which binds to/associates with and/or directs the RNA guided DNA nuclease e.g., CRISPR nuclease to a sequence comprising at least one nucleotide which differs between a mutant allele and a functional allele (e.g., heterozygous SNP) of a gene of interest (i.e., a sequence of the mutant allele which is not present in the functional allele).

In some embodiments, the method comprises the steps of: contacting a mutant allele of a gene of interest with an allele-specific RNA molecule and a CRISPR nuclease e.g., a Cas9 protein, wherein the allele-specific RNA molecule and the CRISPR nuclease e.g., Cas9 associate with a nucleotide sequence of the mutant allele of the gene of interest which differs by at least one nucleotide from a nucleotide sequence of a functional allele of the gene of interest, thereby modifying or knocking-out the mutant allele.

In some embodiments, the allele-specific RNA molecule and a CRISPR nuclease is introduced to a cell encoding the gene of interest. In some embodiments, the cell encoding the gene of interest is in a mammalian subject. In some embodiments, the cell encoding the gene of interest is in a plant.

In some embodiments, the cleaved mutant allele is further subjected to insertion or deletion (indel) by an error prone non-homologous end joining (NHEJ) mechanism, generating a frameshift in the mutant allele's sequence. In some embodiments, the generated frameshift results in inactivation or knockout of the mutant allele. In some embodiments, the generated frameshift creates an early stop codon in the mutant allele and results in generation of a truncated protein. In such embodiments, the method results in the generation of a truncated protein encoded by the mutant allele and a functional protein encoded by the functional allele. In some embodiments, a frameshift generated in a mutant allele using the methods of the invention results in nonsense-mediated mRNA decay of the transcript of the mutant allele.

In some embodiments, the mutant allele is an allele of CXCR4 gene. In some embodiments, the RNA molecule targets a heterozygous SNP of the CXCR4 gene which co-exists with/is genetically linked to the mutated sequence associated with WHIM genetic disorder. In some embodiments, the RNA molecule targets a heterozygous SNP of the CXCR4 gene, wherein the heterozygosity of said SNP is highly prevalent in the population. In embodiments of the present invention, the REF nucleotide is prevalent in the mutant allele and not in the functional allele of an individual subject to be treated. In embodiments of the present invention, the ALT nucleotide is prevalent in the mutant allele and not in the functional allele of an individual subject to be treated. In some embodiments, a disease-causing mutation within a mutant CXCR4 allele is targeted.

In embodiments of the present invention, the heterozygous SNP may or may not be associated with an CXCR4 related disease phenotype. In embodiments of the present invention, the heterozygous SNP is associated with an CXCR4 related disease phenotype. In embodiments of the present invention, the SNP is not associated with an CXCR4 related disease phenotype In some embodiments, the heterozygous SNP is within an exon of the gene of interest. In such embodiments, a guide sequence portion of an RNA molecule may be designed to associate with a sequence of the exon of the gene of interest.

In some embodiments, a heterozygous SNP is within an intron or an exon of the gene of interest. In some embodiments, a heterozygous SNP is in a splice site between the intron and the exon.

A skilled artisan will appreciate that in all of the embodiments of the present invention, each of the RNA molecules of the present invention are capable of complexing with a CRISPR nuclease such as to associate with a target genomic DNA sequence of interest next to a protospacer adjacent motif (PAM). The CRISPR nuclease then mediates cleavage of target DNA to create a double-stranded break within the protospacer. Accordingly, in embodiments of the present invention, the guide sequences and RNA molecules of the present invention may target a location 1, 2, 3, 4, 5, 6, 7, 8, 9, 10, 11, 12, 13, 14, 15, 16, 17, 18, 19, 20, 21, 22, 23, 24, 25, 26, 27, or 28 nucleotides upstream or downstream from a PAM site. In embodiments of the present invention, the guide sequences and RNA molecules of the present invention may target a location that is within the PAM site.

Therefore, in embodiments of the present invention, the RNA molecules of the present invention may affect a double strand break in an allele of a gene 1, 2, 3, 4, 5, 6, 7, 8, 9, 10, 11, 12, 13, 14, 15, 16, 17, 18, 19, 20, 21, 22, 23, 24, 25, 26, 27, 28 upstream or downstream from a polymorphic site. In further embodiments of the invention, the polymorphic site is within the PAM site. A skilled artisan will appreciate that where a heterozygous polymorphic site is present, an RNA molecule may be designed to affect a double stranded break in only the REF or ALT nucleotide base of the heterozygous polymorphic site.

In embodiments of the present invention, an RNA molecule is designed to target a heterozygous polymorphic site present in the CXCR4 gene, wherein the RNA molecule targets only the nucleotide base, REF or ALT, of the heterozygous polymorphic site present in only the mutant allele of the CXCR4 gene Each possibility represents a separate embodiment of the present invention. In some embodiments, a guide sequence portion of an RNA molecule may be designed to associate with a sequence of the gene of interest which comprises the splice site.

In some embodiments, the method is utilized for treating a subject having a disease phenotype resulting from the heterozygote CXCR4 gene. In such embodiments, the method results in improvement, amelioration or prevention of the disease phenotype.

Embodiments referred to above refer to a CRISPR nuclease, RNA molecule(s), and tracrRNA being effective in a subject or cells at the same time. The CRISPR, RNA molecule(s), and tracrRNA can be delivered substantially at the same time or can be delivered at different times but have effect at the same time. For example, this includes delivering the CRISPR nuclease to the subject or cells before the RNA molecule and/or tracr RNA is substantially extant in the subject or cells.

According to embodiments of the present invention, there is provided a method for inactivating a mutant allele of the CXCR4 gene in a cell, the method comprising the steps of:

a) selecting a cell with an CXCR4 gene mutation associate with WHIM and who is heterozygous at one or more polymorphic sites in the CXCR4 gene selected from table 1;
b) introducing to the cell a composition comprising:
   a CRISPR nuclease, and
   a first RNA molecule comprising a guide sequence portion having 17-25 nucleotides,
wherein a complex of the CRISPR nuclease and the first RNA molecule affects a double strand break in only the mutant allele of the CXCR4 gene and not in the functional allele of the CXCR4 gene in the cell;
thereby inactivating only the mutant allele of the CXCR4 gene in the cell.

According to embodiments of the present invention, there is provided a method for inactivating a mutant allele of the CXCR4 gene in a cell, the method comprising the steps of:
a) selecting a cell with an CXCR4 gene mutation associated with WHIM syndrome and who is heterozygous at one or more polymorphic sites in the CXCR4 gene selected from table 1;
b) introducing to the cell a composition comprising:
   a CRISPR nuclease, and
   a first RNA molecule comprising a guide sequence portion having 17-25 nucleotides,
wherein a complex of the CRISPR nuclease and the first RNA molecule affects a double strand break in only the mutant allele of the CXCR4 gene and not in the functional allele of the CXCR4 gene in the cell;
and wherein the method further comprises introduction of a second RNA molecule comprising a guide sequence portion capable of complexing with a CRISPR nuclease, wherein the complex of the second RNA molecule and the CRISPR nuclease affects a second double strand break in the CXCR4 gene;
thereby inactivating only the mutant allele of the CXCR4 gene in the cell.

According to embodiments of the present invention, there is provided a method for inactivating a mutant allele of the CXCR4 gene in a cell with an CXCR4 gene mutation associated with WHIM syndrome and which cell is heterozygous at one or more polymorphic sites in the CXCR4 gene selected from table 1, the method comprising
introducing to the cell a composition comprising:
   a CRISPR nuclease, and
   a first RNA molecule comprising a guide sequence portion having 17-25 nucleotides,
wherein a complex of the CRISPR nuclease and the first RNA molecule affects a double strand break in only the mutant allele of the CXCR4 gene and not in the functional allele of the CXCR4 gene in the cell;
thereby inactivating only the mutant allele of the CXCR4 gene in the cell.

According to embodiments of the present invention, there is provided a method for inactivating a mutant allele of the CXCR4 gene in a cell with an CXCR4 gene mutation associated with WHIM syndrome and heterozygous at one or more polymorphic sites in the CXCR4 gene selected from table 1, the method comprising:
introducing to the cell a composition comprising:
   a CRISPR nuclease, and
   a first RNA molecule comprising a guide sequence portion having 17-25 nucleotides,
wherein a complex of the CRISPR nuclease and the first RNA molecule affects a double strand break in only the mutant allele of the CXCR4 gene and not in the functional allele of the CXCR4 gene in the cell;
and wherein the method further comprises introduction of a second RNA molecule comprising a guide sequence portion capable of complexing with a CRISPR nuclease, wherein the complex of the second RNA molecule and CRISPR nuclease affects a second double strand break in the CXCR4 gene;
thereby inactivating only the mutant allele of the CXCR4 gene in the cell.

In embodiments of the present invention, the guide sequence portion of the first RNA molecule comprises 17-25 contiguous nucleotides containing nucleotides in the sequence set forth in any one of SEQ ID NOs: 1-6601.

In embodiments of the present invention, the second double strand break is within a non-coding region of the CXCR4 gene.

In embodiments of the present invention, the non-coding region of the CXCR4 gene is intron 1, intron 2, or 3' UTR.

According to some embodiments of the present invention, there is provided a method for modifying a mutant allele of the CXCR4 gene having a mutation associated with WHIM syndrome in a cell, the method comprising
introducing to the cell a composition comprising:
   a CRISPR nuclease, and
   a first RNA molecule comprising a guide sequence portion having 17-25 nucleotides,
wherein a complex of the CRISPR nuclease and the first RNA molecule affects a double strand break in the mutant allele of the CXCR4 gene.

In some embodiments, the first RNA molecule targets the CRISPR nuclease to the mutation associated with WHIM syndrome.

In some embodiments, the CXCR4 mutation associated with WHIM syndrome is any one of c.1027G>T; c.1027G>A; c.1016_1017del; c.1013C>G; c.1013C>A; c.1006G>T; c.1003G>A; c.1000C>T; c.994G>T; c.786C>A; c.727A>C; c.704G>A; c.582G>C; c.506T>C; c.478G>A; c.458A>C; c.250G>C; c.250G>A; c.153T>A; c.16-14T>A of NM_003467.3.

In some embodiments, the guide sequence portion of the first RNA molecule comprises 17-25 contiguous nucleotides containing nucleotides in the sequence set forth in any one of SEQ ID NOs: 1-6601 that targets a mutation associated with WHIM syndrome.

In some embodiments, the method further comprises introduction of a donor molecule for homology directed repair, alteration, or replacement of the CXCR4 mutant allele.

In some embodiments, the first RNA molecule targets the CRISPR nuclease to a SNP position of the mutant allele.

In some embodiments, the SNP position is any one of rs2734871; rs2680880; rs2471859; rs1453114403; rs17848385; rs1179591969; rs11682928; rs972851766; rs1260455777; rs62160906; or rs9973445.

In some embodiments, the guide sequence portion of the first RNA molecule comprises 17-25 contiguous nucleotides containing nucleotides in the sequence set forth in any one of SEQ ID NOs: 1-6601 that targets a SNP position of the mutant allele.

In some embodiments, the SNP position is in a non-coding region of the CXCR4 mutant allele.

In some embodiments, the non-coding region is any one of a promoter region, 5' UTR, 3' UTR, or an intron.

In some embodiments, the SNP position is in the downstream intergenic region of the CXCR4 mutant allele.

In some embodiments, the SNP position contains a heterozygous SNP.

In some embodiments, the method further comprises introduction of a second RNA molecule comprising a guide sequence portion capable of complexing with a CRISPR nuclease, wherein the complex of the second RNA molecule and CRISPR nuclease affects a second double strand break in the CXCR4 gene or in the intergenic region downstream of the CXCR4 gene.

In some embodiments, the second RNA molecule comprises a non-discriminatory guide portion that targets both functional and mutant CXCR4 alleles.

In some embodiments, a portion of the CXCR4 mutant allele is excised by the first and second RNA molecules.

In some embodiments, the first RNA molecule targets a SNP position in the 3' UTR of the CXCR4 mutant allele, and the second RNA molecule comprises a non-discriminatory guide portion that targets a sequence in an intergenic region downstream of the CXCR4 gene.

In some embodiments, the first RNA molecule targets a SNP position in a intergenic region downstream of the mutant CXCR4 allele, and the second RNA molecule comprises a non-discriminatory guide portion that targets a sequence in the 3' UTR of the CXCR4 gene.

In some embodiments, the guide sequence portion of the second RNA molecule comprises 17-25 contiguous nucleotides containing nucleotides in the sequence set forth in any one of SEQ ID NOs: 1-6601 other than the sequence of the first RNA molecule.

In some embodiments, the second RNA molecule comprises a guide sequence portion that targets a sequence up to 500 basepairs from a CXCR4 polyadenylation sequence.

In some embodiments, the second RNA molecule targets a sequence up to 500 basepairs from the sequence targeted by the first RNA molecule.

According to embodiments of the present invention, there is provided a modified cell obtained by any one of the methods described herein.

According to embodiments of the present invention, there is provided a composition comprising a first RNA molecule comprising a guide sequence portion having 17-25 contiguous nucleotides containing nucleotides in the sequence set forth in any one of SEQ ID NOs 1-6601 and a CRISPR nuclease.

In some embodiments, the composition further comprises a second RNA molecule comprising a guide sequence portion having a sequence that targets a region of the CXCR4 gene or in the intergenic region downstream of the CXCR4 gene.

In some embodiments, the second RNA molecule comprises a non-discriminatory guide portion that targets both functional and mutant CXCR4 alleles.

In some embodiments, the guide sequence portion of the second RNA molecule comprises 17-25 contiguous nucleotides containing nucleotides in the sequence set forth in any one of SEQ ID NOs 1-6601 other than the sequence of guide sequence portion of the first RNA molecule.

According to embodiments of the present invention, there is provided a method for inactivating a mutant CXCR4 allele in a cell, the method comprising delivering to the cell any one of the compositions described herein.

According to embodiments of the present invention, there is provided a method for treating WHIM syndrome, the method comprising delivering to a cell of a subject having WHIM syndrome any one of the compositions described herein.

According to embodiments of the present invention, there is provided a use of any one of the compositions described herein for inactivating a mutant CXCR4 allele in a cell, comprising delivering to the cell any one of the compositions described herein.

According to embodiments of the present invention, there is provided a medicament comprising any one of the compositions described herein for use in inactivating a mutant CXCR4 allele in a cell, wherein the medicament is administered by delivering to the cell any one of the compositions described herein.

According to embodiments of the present invention, there is provided a use of any one of the compositions described herein for treating ameliorating or preventing CXCR4, comprising delivering to a cell of a subject having or at risk of having WHIM syndrome any one of the compositions described herein.

According to embodiments of the present invention, there is provided a medicament comprising any one of the compositions described herein for use in treating ameliorating or preventing WHIM syndrome, wherein the medicament is administered by delivering to a cell of a subject having or at risk of having WHIM syndrome any one of the compositions described herein.)

According to embodiments of the present invention, there is provided a kit for inactivating a mutant CXCR4 allele in a cell, comprising any one of the compositions described herein, and instructions for delivering the composition to the cell.

According to embodiments of the present invention, there is provided a kit for treating WHIM syndrome in a subject, comprising any one of the compositions described herein, and instructions for delivering the composition to the cell of a subject having or at risk of having WHIM syndrome.

Dominant Genetic Disorders

One of skill in the art will appreciate that all subjects with any type of heterozygote genetic disorder (e.g., dominant genetic disorder) may be subjected to the methods described herein. In one embodiment, the present invention may be used to target a gene involved in, associated with, or causative of dominant genetic disorders such as, for example, WHIM. In some embodiments, the dominant genetic disorder is CXCR4 related WHIM syndrome. In some embodiments, the target gene is the CXCR4 gene (Entrez Gene, gene ID No: 7852). Non-limiting examples of mutations associated with WHIM phenotype include c.1027G>T; c.1027G>A; c.1016_1017del; c.1013C>G; c.1013C>A; c.1006G>T; c.1003G>A; c.1000C>T; c.994G>T; c.786C>A; c.727A>C; c.704G>A; c.582G>C; c.506T>C; c.478G>A; c.458A>C; c.250G>C; c.250G>A; c.153T>A; c.16-14T>A of NM_003467.3.

CXCR4 editing strategies include, but are not limited to, (1) knocking out the entire mutated CXCR4 allele; (2) destabilizing the mutated CXCR4 allele; (3) an HDR strategy by targeting the 3' UTR of the CXCR4 gene with a non-discriminatory RNA guide molecule; (4) an HDR strategy to correct pathogenic CXCR4 mutations by specifically targeting the CXCR4 mutant allele; and (5) destabilizing the mutant allele by excision using a first RNA guide molecule that targets CXCR4 pathogenic mutations and a second RNA guide molecule that is non-discriminatory and targets an intergenic region downstream of the 3' UTR of both a functional and mutated CXCR4 allele.

More specifically, for CXCR4 allele specific knockout, two guide sequences may be utilized. The first guide targets SNPs located in a CXCR4 non-coding region such as a promoter, 5'UTR, intron, 3'UTR or intergenic region. The second guide may target non-coding regions located downstream or upstream to the CXCR4 coding exon, according to the location of the discriminatory SNP. For example, if the discriminatory SNP is located in the promoter, 5' UTR or intron (e.g. rs62160906, rs9973445, rs2680880, rs2471859 and rs11682928), the non-discriminatory guide may target the 3' UTR or intergenic regions located downstream to the CXCR4 gene in order to lead to excision of the coding exon.

Another optional strategy is to destabilize a mutated CXCR4 transcript by excising the 3'UTR by targeting a SNP in the downstream intergenic region of CXCR4 with a first guide and using a second, non-discriminatory guide targeting a sequence in the 3'UTR that is upstream to the polyadenylation signal. Alternatively, a first guide may target a SNP located in the intergenic region downstream of the CXCR4 3'UTR (e.g. rs2734871), and a second, non-discriminatory guide may target a sequence in the 3'UTR upstream to a polyadenylation signal.

In a general HDR strategy, a non-discriminatory gRNA may target a sequence in the 3' UTR of the CXCR4 gene that is common to all CXCR4 transcripts, preferably in a region such that the editing profile will not impair the stop codon or the polyadenylation signal. The donor may be a ssODN, ddODN (e.g. a PCR product) or a AAV-donor comprising homology arms covering the mutations region.

CRISPR Nucleases and PAM Recognition

In some embodiments, the sequence specific nuclease is selected from CRISPR nucleases, or a functional variant thereof. In some embodiments, the sequence specific nuclease is an RNA guided DNA nuclease. In such embodiments, the RNA sequence which guides the RNA guided DNA nuclease (e.g., Cpf1) binds to and/or directs the RNA guided DNA nuclease to the sequence comprising at least one nucleotide which differs between a mutant allele and its counterpart functional allele (e.g., SNP). In some embodiments, the CRISPR complex does not further comprise a tracrRNA. In a non-limiting example, in which the RNA guided DNA nuclease is a CRISPR protein, the at least one nucleotide which differs between the dominant mutant allele and the functional allele may be within the PAM site and/or proximal to the PAM site within the region that the RNA molecule is designed to hybridize to. A skilled artisan will appreciate that RNA molecules can be engineered to bind to a target of choice in a genome by commonly known methods in the art.

In embodiments of the present invention, a type II CRISPR system utilizes a mature crRNA:tracrRNA complex directs a CRISPR nuclease, e.g. Cas9, to the target DNA via Watson-Crick base-pairing between the crRNA and the protospacer on the target DNA next to the protospacer adjacent motif (PAM), an additional requirement for target recognition. The CRISPR nuclease then mediates cleavage of target DNA to create a double-stranded break within the protospacer. A skilled artisan will appreciate that each of the engineered RNA molecule of the present invention is further designed such as to associate with a target genomic DNA sequence of interest next to a protospacer adjacent motif (PAM), e.g., a PAM matching the sequence relevant for the type of CRISPR nuclease utilized, such as for a non-limiting example, NGG or NAG, wherein "N" is any nucleobase, for *Streptococcus pyogenes* Cas9 WT (Sp-CAS9); NNGRRT for *Staphylococcus aureus* (SaCas9); NNNVRYM for *Jejuni* Cas9 WT; NGAN or NGNG for SpCas9-VQR variant; NGCG for SpCas9-VRER variant; NGAG for SpCas9-EQR variant; NNNNGATT for *Neisseria meningitidis* (NmCas9); or TTTV for Cpf1. RNA molecules of the present invention are each designed to form complexes in conjunction with one or more different CRISPR nucleases and designed to target polynucleotide sequences of interest utilizing one or more different PAM sequences respective to the CRISPR nuclease utilized.

In some embodiments, an RNA-guided DNA nuclease e.g., a CRISPR nuclease, may be used to cause a DNA break, either double or single-stranded in nature, at a desired location in the genome of a cell. The most commonly used RNA-guided DNA nucleases are derived from CRISPR systems, however, other RNA-guided DNA nucleases are also contemplated for use in the genome editing compositions and methods described herein. For instance, see U.S. Patent Publication No. 2015/0211023, incorporated herein by reference.

CRISPR systems that may be used in the practice of the invention vary greatly. CRISPR systems can be a type I, a type II, or a type III system. Non-limiting examples of suitable CRISPR proteins include Cas3, Cas4, Cas5, Cas5e (or CasD), Cas6, Cas6e, Cas6f, Cas7, Cas8a1, Cas8a2, Cas8b, Cas8c, Cas9, Cas10, Casl Od, CasF, CasG, CasH, Csy1, Csy2, Csy3, Cse1 (or CasA), Cse2 (or CasB), Cse3 (or CasE), Cse4 (or CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csz1, Csx15, Csf1, Csf2, Csf3, Csf4, and Cul966.

In some embodiments, the RNA-guided DNA nuclease is a CRISPR nuclease derived from a type II CRISPR system (e.g., Cas9). The CRISPR nuclease may be derived from *Streptococcus pyogenes, Streptococcus thermophilus, Streptococcus* sp., *Staphylococcus aureus, Neisseria meningitidis, Treponema denticola, Nocardiopsis dassonvillei, Streptomyces pristinaespiralis, Streptomyces viridochromogenes, Streptomyces viridochromogenes, Streptosporangium roseum, Streptosporangium roseum, Alicyclobacillus acidocaldarius, Bacillus pseudomycoides, Bacillus selenitireducens, Exiguobacterium sibiricum, Lactobacillus delbrueckii, Lactobacillus salivarius, Microscilla marina, Burkholderiales bacterium, Polaromonas naphthalenivorans, Polaromonas* sp., *Crocosphaera watsonii, Cyanothece* sp., *Microcystis aeruginosa, Synechococcus* sp., *Acetohalobium arabaticum, Ammonifex degensii, Caldicelulosiruptor becscii, Candidatus Desulforudis, Clostridium botulinum, Clostridium Finegoldia magna, Natranaerobius thermophilus, Pelotomaculum thermopropionicum, Acidithiobacillus caldus, Acidithiobacillus ferrooxidans, Allochromatiurn vinosum, Marinobacter* sp., *Nitrosococcus halophilus, Nitrosococcus watsoni, Pseudoalteromonas haloplanktis, Ktedonobacter racemifer, Methanohalobiurn evestigatum, Anabaena variabilis, Nodularia spumigena, Nostoc* sp., *Arthrospira maxima, Arthrospira platensis, Arthrospira* sp., *Lyngbya* sp., *Microcoleus chthonoplastes, Oscillatoria* sp., *Petrotoga mobilis, Thermosipho africanus, Acaryochloris marina*, or any species which encodes a CRISPR nuclease with a known PAM sequence. CRISPR nucleases encoded by uncultured bacteria may also be used in the context of the invention. (See Burstein et al. Nature, 2017). Variants of CRIPSR proteins having known PAM sequences e.g., spCas9 D1135E variant, spCas9 VQR variant, spCas9 EQR variant, or spCas9 VRER variant may also be used in the context of the invention.

Thus, an RNA guided DNA nuclease of a CRISPR system, such as a Cas9 protein or modified Cas9 or homolog or ortholog of Cas9, or other RNA guided DNA nucleases belonging to other types of CRISPR systems, such as Cpf1 and its homologs and orthologs, may be used in the compositions of the present invention.

In certain embodiments, the CRIPSR nuclease may be a "functional derivative" of a naturally occurring Cas protein.

A "functional derivative" of a native sequence polypeptide is a compound having a qualitative biological property in common with a native sequence polypeptide. "Functional derivatives" include, but are not limited to, fragments of a native sequence and derivatives of a native sequence polypeptide and its fragments, provided that they have a biological activity in common with a corresponding native sequence polypeptide. A biological activity contemplated herein is the ability of the functional derivative to hydrolyze a DNA substrate into fragments. The term "derivative" encompasses both amino acid sequence variants of polypeptide, covalent modifications, and fusions thereof. Suitable derivatives of a Cas polypeptide or a fragment thereof include but are not limited to mutants, fusions, covalent modifications of Cas protein or a fragment thereof. Cas protein, which includes Cas protein or a fragment thereof, as well as derivatives of Cas protein or a fragment thereof, may be obtainable from a cell or synthesized chemically or by a combination of these two procedures. The cell may be a cell that naturally produces Cas protein, or a cell that naturally produces Cas protein and is genetically engineered to produce the endogenous Cas protein at a higher expression level or to produce a Cas protein from an exogenously introduced nucleic acid, which nucleic acid encodes a Cas that is same or different from the endogenous Cas. In some cases, the cell does not naturally produce Cas protein and is genetically engineered to produce a Cas protein.

In some embodiments, the CRISPR nuclease is Cpf1. Cpf1 is a single RNA-guided endonuclease which utilizes a T-rich protospacer-adjacent motif. Cpf1 cleaves DNA via a staggered DNA double-stranded break. Two Cpf1 enzymes from Acidaminococcus and Lachnospiraceae have been shown to carry out efficient genome-editing activity in human cells. (See Zetsche et al. (2015) Cell).

Thus, an RNA guided DNA nuclease of a Type II CRISPR System, such as a Cas9 protein or modified Cas9 or homologs, orthologues, or variants of Cas9, or other RNA guided DNA nucleases belonging to other types of CRISPR systems, such as Cpf1 and its homologs, orthologues, or variants, may be used in the present invention.

In some embodiments, the guide molecule comprises one or more chemical modifications which imparts a new or improved property (e.g., improved stability from degradation, improved hybridization energetics, or improved binding properties with an RNA guided DNA nuclease). Suitable chemical modifications include, but are not limited to: modified bases, modified sugar moieties, or modified internucleoside linkages. Non-limiting examples of suitable chemical modifications include: 4-acetylcytidine, 5-(carboxyhydroxymethyl)uridine; 2'-O-methylcytidine, 5-carboxymethylaminomethyl-2-thiouridine, 5-carboxymethylaminomethyluridine, dihydrouridine, 2'-O-methylpseudouridine, "beta, D-galactosylqueuosine", 2'-O-methylguanosine, inosine, N6-isopentenyladenosine, 1-methyladenosine, 1-methylpseudouridine, 1-methylguanosine, 1-methylinosine; "2,2-dimethylguanosine", 2-methyladenosine; 2-methylguanosine, 3-methylcytidine, 5-methylcytidine, N6-methyladenosine, 7-methylguanosine, 5-methylaminomethyluridine, 5-methoxyaminomethyl-2-thiouridine, "beta, D-mannosylqueuosine", 5-methoxycarbonylmethyl-2-thiouridine, 5-methoxycarbonylmethyluridine, 5-methoxyuridine, 2-methylthio-N6-isopentenyladenosine, N-((9-beta-D-ribofuranosyl-2-methylthiopurine-6-yl)carbamoyl)threonine, N-((9-beta-D-ribofuranosylpurine-6-yl)N-methylcarbamoyl)threonine, uridine-5-oxyacetic acid-methylester, uridine-5-oxyacetic acid, wybutoxosine, queuosine, 2-thiocytidine, 5-methyl-2-thiouridine; 2-thiouridine, 4-thiouridine, 5-methyluridine, N-((9-beta-D-ribofuranosylpurine-6-yl)-carbamoyl)threonine, 2'-O-methyl-5-methyluridine, 2'-O-methyluridine, wybutosine, "3-(3-amino-3-carboxy-propyl)uridine, (acp3) u", 2'-O-methyl (M), 3'-phosphorothioate (MS), 3'-thioPACE (MSP), pseudouridine, or 1-methyl pseudo-uridine. Each possibility represents a separate embodiment of the present invention.

Guide Sequences which Specifically Target a Mutant Allele

A given gene may contain thousands of SNPs. Utilizing a 24 base pair target window for targeting each SNP in a gene would require hundreds of thousands of guide sequences. Any given guide sequence when utilized to target a SNP may result in degradation of the guide sequence, limited activity, no activity, or off-target effects. Accordingly, suitable guide sequences are necessary for targeting a given gene. By the present invention, a novel set of guide sequences have been identified for knocking out expression of a mutated protein, inactivating a mutant CXCR4 gene allele, and treating WHIM syndrome.

The present disclosure provides guide sequences capable of specifically targeting a mutant allele for inactivation while leaving the functional allele unmodified. The guide sequences of the present invention are designed to, and are most likely to, specifically differentiate between a mutant allele and a functional allele. Of all possible guide sequences which target a mutant allele desired to be inactivated, the specific guide sequences disclosed herein are specifically effective to function with the disclosed embodiments.

Briefly, the guide sequences may have properties as follows: (1) target a heterozygous SNP/insertion/deletion/indel with a high prevalence in the general population, in a specific ethnic population or in a patient population is above 1% and the SNP/insertion/deletion/indel heterozygosity rate in the same population is above 1%; (2) target a location of a SNP/insertion/deletion/indel proximal to a portion of the gene e.g., within 5 k bases of any portion of the gene, for example, a promoter, a UTR, an exon or an intron; and (3) target a mutant allele using an RNA molecule which targets a founder or common pathogenic mutations for the disease/gene. In some embodiments, the prevalence of the SNP/insertion/deletion/indel in the general population, in a specific ethnic population or in a patient population is above 1%, 2%, 3%, 4%, 5%, 6%, 7%, 8%, 9%, 10%, 11%, 12%, 13%, 14%, or 15% and the SNP/insertion/deletion/indel heterozygosity rate in the same population is above 1%, 2%, 3%, 4%, 5%, 6%, 7%, 8%, 9%, 10%, 11%, 12%, 13%, 14%, or 15%. Each possibility represents a separate embodiment and may be combined at will.

For each gene, according to SNP/insertion/deletion/indel any one of the following strategies may be used to deactivate the mutant allele: (1) Knockout strategy using one RNA molecule—one RNA molecule is utilized to direct a CRISPR nuclease to a mutant allele and create a double-strand break (DSB) leading to formation of a frameshift mutation in an exon or in a splice site region of the mutant allele; (2) Knockout strategy using two RNA molecules—two RNA molecules are utilized. A first RNA molecule targets a region in the promoter or an upstream region of a mutant allele and another RNA molecule targets downstream of the first RNA molecule in a promoter, exon, or intron of the mutant allele; (3) Exon(s) skipping strategy—one RNA molecule may be used to target a CRISPR nuclease to a splice site region, either at the 5'end of an intron (donor sequence) or the 3' end of an intron (acceptor sequence), in order to destroy the splice site. Alternatively, two RNA molecules may be utilized such that a first RNA molecule targets an upstream region of an exon and a second RNA molecule targets a region downstream of the first RNA molecule, thereby excising the exon(s). Based on the locations of identified SNPs/insertions/deletions/indels for each mutant allele, any one of, or a combination of, the above-mentioned methods to deactivate the mutant allele may be utilized.

When only one RNA molecule is used is that the location of the SNP is in an exon or in close proximity (e.g., within 20 basepairs) to a splice site between the intron and the exon such as exon 2. When two RNA molecules are used, the first guide sequence may target a SNPs such that the first SNP is in intron 1, and the second guide sequence targets a sequence within intron 2, or 3' UTR.

Guide sequences of the present invention may target a SNP in the upstream portion of the targeted gene, preferably upstream of the last exon of the targeted gene. Guide sequences may target a SNP upstream to exon 1, for example within the 5' untranslated region, or within the promoter or within the first 4-5 kilobases 5' of the transcription start site.

Guide sequences of the present invention may also target a SNP within close proximity (e.g., within 50 basepairs, more preferably with 20 basepairs) to a known protospacer adjacent motif (PAM) site.

Guide sequences of the present invention also may target: (1) a heterozygous SNP for the targeted gene; (2) a heterozygous SNPs upstream and downstream of the gene; (3) a SNPs with a prevalence of the SNP/insertion/deletion/indel in the general population, in a specific ethnic population, or in a patient population above 1%; (4) have a guanine-cytosine content of greater than 30% and less than 85%; (5) have no repeat of 4 or more thymine/uracil or 8 or more guanine, cytosine, or adenine; (6) having no off-target identified by off-target analysis; and (7) preferably target Exons over Introns or be upstream of a SNP rather than downstream of a SNP.

In embodiments of the present invention, the SNP may be upstream or downstream of the gene. In embodiments of the present invention, the SNP is within 4,000 base pairs upstream or downstream of the gene.

The at least one nucleotide which differs between the mutant allele and the functional allele, may be upstream, downstream or within the sequence of the disease-causing mutation of the gene of interest. The at least one nucleotide which differs between the mutant allele and the functional allele, may be within an exon or within an intron of the gene of interest. In some embodiments, the at least one nucleotide which differs between the mutant allele and the functional allele is within an exon of the gene of interest. In some embodiments, the at least one nucleotide which differs between the mutant allele and the functional allele is within an intron or an exon of the gene of interest, in close proximity to a splice site between the intron and the exon e.g., 1, 2, 3, 4, 5, 6, 7, 8, 9, 10, 11, 12, 13, 14, 15, 16, 17, 18, 19, or 20 nucleotides upstream or downstream to the splice site.

In some embodiments, the at least one nucleotide is a single nucleotide polymorphisms (SNPs). In some embodiments, each of the nucleotide variants of the SNP may be expressed in the mutant allele. In some embodiments, the SNP may be a founder or common pathogenic mutation.

Guide sequences may target a SNP which has both (1) a high prevalence in the general population e.g., above 1% in the population; and (2) a high heterozygosity rate in the population, e.g., above 1%. Guide sequences may target a SNP that is globally distributed. A SNP may be a founder or common pathogenic mutation. In some embodiments, the prevalence in the general population is above 1%, 2%, 3%, 4%, 5%, 6%, 7%, 8%, 9%, 10%, 11%, 12%, 13%, 14%, or 15%. Each possibility represents a separate embodiment. In some embodiments, the heterozygosity rate in the population is above 1%, 2%, 3%, 4%, 5%, 6%, 7%, 8%, 9%, 10%, 11%, 12%, 13%, 14%, or 15%. Each possibility represents a separate embodiment.

In some embodiments, the at least one nucleotide which differs between the mutant allele and the functional allele is linked to/co-exists with the disease-causing mutation in high prevalence in a population. In such embodiments, "high prevalence" refers to at least 92%, 93%, 94%, 95%, 96%, 97%, 98%, 99%, or 100%. Each possibility represents a separate embodiment of the present invention. In one embodiment, the at least one nucleotide which differs between the mutant allele and the functional allele, is a disease-associated mutation. In some embodiments, the SNP is highly prevalent in the population. In such embodiments, "highly prevalent" refers to at least 10%, 11%, 12%, 13%, 14%, 15%, 20%, 30%, 40%, 50%, 60%, or 70% of a population. Each possibility represents a separate embodiment of the present invention.

Guide sequences of the present invention may satisfy any one of the above criteria and are most likely to differentiate between a mutant allele from its corresponding functional allele.

In some embodiments the RNA molecule targets a heterozygous SNP present in the CXCR4 gene from the SNPs as shown in Table 1 below.

Delivery to Cells

It is understood that in the methods embodied, the RNA molecules and compositions described herein may be delivered to a target cell or subject by any suitable means. The following embodiments provide non-limiting examples of methods of delivery of the RNA molecules and composition of the present invention.

In some embodiments, RNA molecule compositions of the present invention may be targeted to any cell which contains and/or expresses a dominant negative allele, including any mammalian or plant cell. For example, in one embodiment the RNA molecule specifically targets a mutant CXCR4 allele and the target cell is a stem cell.

In some embodiments, the RNA molecule comprises a chemical modification. Non-limiting examples of suitable chemical modifications include 2'-0-methyl (M), 2'-0-methyl, 3'phosphorothioate (MS) or 2'-0-methyl, 3 Thio-PACE (MSP), pseudouridine, and 1-methyl pseudo-uridine. Each possibility represents a separate embodiment of the present invention.

Any suitable viral vector system may be used to deliver nucleic acid compositions e.g., the RNA molecule compositions of the subject invention. Conventional viral and non-viral based gene transfer methods can be used to introduce nucleic acids and target tissues. In certain embodiments, nucleic acids are administered for in vivo or ex vivo gene therapy uses. Non-viral vector delivery systems include naked nucleic acid, and nucleic acid complexed with a delivery vehicle such as a liposome or poloxamer. For a review of gene therapy procedures, see Anderson (1992) Science 256:808-813; Nabel & Felgner (1993) TIBTECH 11:211-217; Mitani & Caskey (1993) TIBTECH 11:162-166; Dillon (1993) TIBTECH 11:167-175; Miller (1992) Nature 357:455-460; Van Brunt (1988) Biotechnology 6(10):1149-1154; Vigne (1995) Restorative Neurology and Neuroscience 8:35-36; Kremer & Perricaudet (1995) British Medical Bulletin 51(1):31-44; Haddada et al. (1995) in Current Topics in Microbiology and Immunology Doerfler and Bohm (eds.); and Yu et al. (1994) Gene Therapy 1:13-26.

Methods of non-viral delivery of nucleic acids and/or proteins include electroporation, lipofection, microinjection, biolistics, particle gun acceleration, virosomes, liposomes, immunoliposomes, lipid nanoparticles (LNPs), polycation or lipid:nucleic acid conjugates, artificial virions, and agent-enhanced uptake of nucleic acids or can be delivered to plant cells by bacteria or viruses (e.g., *Agrobacterium, Rhizobium* sp. NGR234, Sinorhizoboiummeliloti, *Mesorhizobium loti*, tobacco mosaic virus, potato virus X, cauliflower mosaic virus and cassava vein mosaic virus). (See, e.g., Chung et al. (2006) Trends Plant Sci. 11(1):1-4). Sonoporation using, e.g., the Sonitron 2000 system (Rich-Mar), can also be used for delivery of nucleic acids. Cationic-lipid mediated delivery of proteins and/or nucleic acids is also contemplated as an in vivo or in vitro delivery method. (See Zuris et al. (2015) Nat. Biotechnol. 33(1):73-80; see also Coelho et al. (2013) N. Engl. J. Med. 369, 819-829; Judge et al. (2006) Mol. Ther. 13, 494-505; and Basha et al. (2011) Mol. Ther. 19, 2186-2200).

Additional exemplary nucleic acid delivery systems include those provided by Amaxa® Biosystems (Cologne, Germany), Maxcyte, Inc. (Rockville, Md.), BTX Molecular Delivery Systems (Holliston, Mass.) and Copernicus Therapeutics Inc., (see, e.g., U.S. Pat. No. 6,008,336). Lipofection is described in e.g., U.S. Pat. Nos. 5,049,386, 4,946,787; and 4,897,355, and lipofection reagents are sold commercially (e.g., Transfectam™, Lipofectin™ and Lipofectamine™ RNAiMAX). Cationic and neutral lipids that are suitable for efficient receptor-recognition lipofection of polynucleotides include those of Felgner, WO 91/17424, WO 91/16024. Delivery can be to cells (ex vivo administration) or target tissues (in vivo administration).

The preparation of lipid:nucleic acid complexes, including targeted liposomes such as immunolipid complexes, is well known to one of skill in the art (See, e.g., Crystal (1995) Science 270:404-410; Blaese et al. (1995) Cancer Gene Ther. 2:291-297; Behr et al. (1994) Bioconjugate Chem. 5:382-389; Remy et al. (1994) Bioconjugate Chem. 5:647-654; Gao et al. (1995) Gene Therapy 2:710-722; Ahmad et al. (1992) Cancer Res. 52:4817-4820; U.S. Pat. Nos. 4,186, 183, 4,217,344, 4,235,871, 4,261,975, 4,485,054, 4,501,728, 4,774,085, 4,837,028, and 4,946,787).

Additional methods of delivery include the use of packaging the nucleic acids to be delivered into EnGeneIC delivery vehicles (EDVs). These EDVs are specifically delivered to target tissues using bispecific antibodies where one arm of the antibody has specificity for the target tissue and the other has specificity for the EDV. The antibody brings the EDVs to the target cell surface and then the EDV is brought into the cell by endocytosis. Once in the cell, the contents are released (See MacDiarmid et al (2009) Nature Biotechnology 27(7):643).

The use of RNA or DNA viral based systems for viral mediated delivery of nucleic acids take advantage of highly evolved processes for targeting a virus to specific cells in the body and trafficking the viral payload to the nucleus. Viral vectors can be administered directly to patients (in vivo) or they can be used to treat cells in vitro and the modified cells are administered to patients (ex vivo). Conventional viral based systems for the delivery of nucleic acids include, but are not limited to, retroviral, lentivirus, adenoviral, adeno-associated, vaccinia and herpes simplex virus vectors for gene transfer.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system depends on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immunodeficiency virus (SIV), human immunodeficiency virus (HIV), and combinations thereof (See, e.g., Buchschacher et al. (1992) J. Virol. 66:2731-2739; Johann et al. (1992) J. Virol. 66:1635-1640; Sommerfelt et al. (1990) Virol. 176:58-59; Wilson et al. (1989) J. Virol. 63:2374-2378; Miller et al. (1991) J. Virol. 65:2220-2224; PCT/US94/05700).

At least six viral vector approaches are currently available for gene transfer in clinical trials, which utilize approaches that involve complementation of defective vectors by genes inserted into helper cell lines to generate the transducing agent.

pLASN and MFG-S are examples of retroviral vectors that have been used in clinical trials (Dunbar et al. (1995) Blood 85:3048-305; Kohn et al. (1995) Nat. Med. 1:1017-102; Malech et al. (1997) PNAS 94:22 12133-12138). PA317/pLASN was the first therapeutic vector used in a gene therapy trial. (Blaese et al. (1995). Transduction efficiencies of 50% or greater have been observed for MFG-S packaged vectors. (Ellem et al. (1997) Immunol Immunother. 44(1):10-20; Dranoff et al. (1997) Hum. Gene Ther. 1:111-2).

Packaging cells are used to form virus particles that are capable of infecting a host cell. Such cells include 293 cells, which package adenovirus, AAV, and Psi-2 cells or PA317 cells, which package retrovirus. Viral vectors used in gene therapy are usually generated by a producer cell line that packages a nucleic acid vector into a viral particle. The vectors typically contain the minimal viral sequences required for packaging and subsequent integration into a host (if applicable), other viral sequences being replaced by an expression cassette encoding the protein to be expressed. The missing viral functions are supplied in trans by the packaging cell line. For example, AAV vectors used in gene therapy typically only possess inverted terminal repeat (ITR) sequences from the AAV genome which are required for packaging and integration into the host genome. Viral DNA is packaged in a cell line, which contains a helper plasmid encoding the other AAV genes, namely rep and cap, but lacking ITR sequences. The cell line is also infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additionally, AAV can be produced at clinical scale using baculovirus systems (see U.S. Pat. No. 7,479,554).

In many gene therapy applications, it is desirable that the gene therapy vector be delivered with a high degree of specificity to a particular tissue type. Accordingly, a viral vector can be modified to have specificity for a given cell type by expressing a ligand as a fusion protein with a viral coat protein on the outer surface of the virus. The ligand is chosen to have affinity for a receptor known to be present on the cell type of interest. For example, Han et al. (1995) Proc. Natl. Acad. Sci. USA 92:9747-9751, reported that Moloney murine leukemia virus can be modified to express human heregulin fused to gp70, and the recombinant virus infects certain human breast cancer cells expressing human epidermal growth factor receptor. This principle can be extended to other virus-target cell pairs, in which the target cell expresses a receptor and the virus expresses a fusion protein comprising a ligand for the cell-surface receptor. For example, filamentous phage can be engineered to display antibody fragments (e.g., FAB or Fv) having specific binding affinity for virtually any chosen cellular receptor. Although the above description applies primarily to viral vectors, the same principles can be applied to nonviral vectors. Such vectors can be engineered to contain specific uptake sequences which favor uptake by specific target cells.

Gene therapy vectors can be delivered in vivo by administration to an individual patient, typically by systemic administration (e.g., intravitreal, intravenous, intraperitoneal, intramuscular, subdermal, or intracranial infusion) or topical application, as described below. Alternatively, vectors can be delivered to cells ex vivo, such as cells explanted from an individual patient (e.g., lymphocytes, bone marrow aspirates, tissue biopsy) or universal donor hematopoietic stem cells, followed by reimplantation of the cells into a patient, usually after selection for cells which have incorporated the vector.

Ex vivo cell transfection for diagnostics, research, or for gene therapy (e.g., via re-infusion of the transfected cells into the host organism) is well known to those of skill in the art. In a preferred embodiment, cells are isolated from the subject organism, transfected with a nucleic acid composition, and re-infused back into the subject organism (e.g., patient). Various cell types suitable for ex vivo transfection are well known to those of skill in the art (See, e.g., Freshney et al. (1994) Culture of Animal Cells, A Manual of Basic Technique, 3rd ed, and the references cited therein for a discussion of how to isolate and culture cells from patients).

Suitable cells include, but are not limited to, eukaryotic cells and/or cell lines. Non-limiting examples of such cells or cell lines generated from such cells include COS, CHO (e.g., CHO-S, CHO-K1, CHO-DG44, CHO-DUXB11, CHO-DUKX, CHOK1SV), VERO, MDCK, WI38, V79, B14AF28-G3, BHK, HaK, NSO, SP2/0-Ag14, HeLa, HEK293 (e.g., HEK293-F, HEK293-H, HEK293-T), perC6 cells, any plant cell (differentiated or undifferentiated), as well as insect cells such as Spodopterafugiperda (Sf), or fungal cells such as *Saccharomyces, Pichia* and *Schizosaccharomyces*. In certain embodiments, the cell line is a CHO-K1, MDCK or HEK293 cell line. Additionally, primary cells may be isolated and used ex vivo for reintroduction into the subject to be treated following treatment with a guided nuclease system (e.g. CRISPR/Cas). Suitable primary cells include peripheral blood mononuclear cells (PBMC), and other blood cell subsets such as, but not limited to, CD4+ T cells or CD8+ T cells. Suitable cells also include stem cells such as, by way of example, embryonic stem cells, induced pluripotent stem cells, hematopoietic stem cells (CD34+), neuronal stem cells and mesenchymal stem cells.

In one embodiment, stem cells are used in ex vivo procedures for cell transfection and gene therapy. The advantage to using stem cells is that they can be differentiated into other cell types in vitro, or can be introduced into a mammal (such as the donor of the cells) where they will engraft in the bone marrow. Methods for differentiating CD34+ cells in vitro into clinically important immune cell types using cytokines such a GM-CSF, IFN-gamma, and TNF-alpha are known (as a non-limiting example see, Inaba et al., J. Exp. Med. 176:1693-1702 (1992)).

Stem cells are isolated for transduction and differentiation using known methods. For example, stem cells are isolated from bone marrow cells by panning the bone marrow cells with antibodies which bind unwanted cells, such as CD4+ and CD8+(T cells), CD45+(panB cells), GR-1 (granulocytes), and Tad (differentiated antigen presenting cells) (as a non-limiting example see Inaba et al. (1992) J. Exp. Med. 176:1693-1702). Stem cells that have been modified may also be used in some embodiments.

Any one of the RNA molecule compositions described herein is suitable for genome editing in post-mitotic cells or any cell which is not actively dividing, e.g., arrested cells.

Vectors (e.g., retroviruses, liposomes, etc.) containing therapeutic nucleic acid compositions can also be administered directly to an organism for transduction of cells in vivo. Administration is by any of the routes normally used for introducing a molecule into ultimate contact with blood or tissue cells including, but not limited to, injection, infusion, topical application (e.g., eye drops and cream) and electroporation. Suitable methods of administering such nucleic acids are available and well known to those of skill in the art, and, although more than one route can be used to administer a particular composition, a particular route can often provide a more immediate and more effective reaction than another route. According to some embodiments, the composition is delivered via IV injection.

Vectors suitable for introduction of transgenes into immune cells (e.g., T-cells) include non-integrating lentivirus vectors. See, e.g., U U.S. Patent Publication No. 2009/0117617.

Pharmaceutically acceptable carriers are determined in part by the particular composition being administered, as well as by the particular method used to administer the composition. Accordingly, there is a wide variety of suitable formulations of pharmaceutical compositions available, as described below (See, e.g., Remington's Pharmaceutical Sciences, 17th ed., 1989).

In accordance with some embodiments, there is provided an RNA molecule which binds to/associates with and/or directs the RNA guided DNA nuclease to a sequence comprising at least one nucleotide which differs between a mutant allele and a functional allele (e.g., SNP) of a gene of interest (i.e., a sequence of the mutant allele which is not present in the functional allele). The sequence may be within the disease associated mutation. The sequence may be upstream or downstream to the disease associated mutation. Any sequence difference between the mutant allele and the functional allele may be targeted by an RNA molecule of the present invention to inactivate the mutant allele, or otherwise disable its dominant disease-causing effects, while preserving the activity of the functional allele.

The disclosed compositions and methods may also be used in the manufacture of a medicament for treating dominant genetic disorders in a patient.

Mechanisms of Action for Several Embodiments Disclosed Herein

CXCR4 has several protein coding transcripts, differing in their N-terminus. The shorter transcript contains only a single exon with a promoter region located within intron 1 of the longer transcripts. Several mutations located in the C-terminal domain of CXCR4 have been associated with WHIM syndrome. Non-limiting examples of disease associated mutations include: c.1027G>T (p.Glu343Ter), c.1016_1017delCT (p.Ser339Cysfs), c.1013C>G (p.Ser338Ter), c.1003G>A (p.Gly335Ser), and c.1000C>T (p.Arg334Ter).

Without being bound by any theory or mechanism, the instant invention may be utilized to apply a CRISPR nuclease to correct or repair the mutant pathogenic CXCR4 allele and not the functional CXCR4 allele. For example, an allele specific HDR approach involves targeting a CXCR4 mutation with a discriminatory gRNA and providing a ssDON template. In another example, a general HDR strategy involves targeting the 3'UTR of the CXCR gene with a non-discriminatory gRNA, which targets a sequence transcribed in all CXCR4 transcripts, in a region that the editing profile will not impair the stop codon or the polyA signal. The donor may be a ddODN e.g. a PCR product, that comprises homology arms covering the mutations region.

Without being bound by any theory or mechanism, the instant invention may be utilized to apply a CRISPR nuclease to modify the mutant pathogenic CXCR4 allele and not the functional CXCR4 allele, such as to prevent expression of the mutant pathogenic allele or to produce a truncated non-pathogenic peptide from the mutant pathogenic allele, in order to prevent WHIM syndrome.

For an allele specific CXCR4 knockout, two guide sequences may be utilized, wherein the first guide targets one of a SNPs in intron 1 of the CXCR4 (NM 003467.3) as specified in table 1, while the second targets the 3'UTR of the CXCR4 gene.

TABLE 1

List of SNPs relevant for CXCR4 editing strategies described herein.

| RSID* | RS ID** | CXCR4 SNP Position |
|---|---|---|
| 2:136112303_G_A_ | rs2734871 | Downstream region |
| 2:136115979_A_T_ | rs2680880 | Intron_1 of 1 |
| 2:136116434_A_G | rs2471859 | Intron_1 of 1 |
| 2:136117888_A_C_ | rs1453114403 | Intron_1 of 1 |
| 2:136117122_T_G | rs17848385 | Intron_1 of 1 |
| 2:136117886_G_C_ | rs1179591969 | Intron_1 of 1 |
| 2:136117336_G_A | rs11682928 | Intron_1 of 1 |
| 2:136117878_A_C | rs972851766 | Intron_1 of 1 |
| 2:136117882_A_C_ | rs1260455777 | Intron_1 of 1 |
| 2:136120697_C_T | rs62160906 | Upstream region |
| 2:136121046_C_G_ | rs9973445 | Upstream region |
| 2:136112303_G_A | rs2734871 | Downstream region |

*Genome Reference Consortium Human GRCh38.p12 (GCA_000001405.27) Assembly date: December 2013 initial release; December 2017 patch release 12.
**The SNP details SNP ID No. ("rs number") are based on NCBI's 2018 database of Single Nucleotide Polymorphisms (dbSNP)).

According to the Gnomad database, there are healthy individuals harboring heterozygous nonsense or frameshift mutations located upstream to the region of the pathogenic mutations (FIG. 2). Therefore, large C-terminus truncation of the mutant allele may overcome the dominant effect of the mutation.

In some embodiments, particularly those targeting exon 2 of the CXCR4 gene such as rs2228014, the resultant peptide will lack a large portion of the C-terminus of the peptide and therefore the dominant effect of the mutation may be avoided.

Examples of RNA Guide Sequences which Specifically Target Mutant Alleles of CXCR4 Gene Although a large number of guide sequences can be designed to target a mutant allele, the nucleotide sequences described in Table 2 identified by SEQ ID NOs: 1-6601 below were specifically selected to effectively implement the methods set forth herein and to effectively discriminate between alleles.

Referring to columns 1-4, each of SEQ ID NOs: 1-6601 indicated in column 1 corresponds to an engineered guide sequence. The corresponding SNP details are indicated in column 3 and 4.

Table 2 shows guide sequences designed for use as described in the embodiments above to associate with different SNPs within a sequence of a mutant CXCR4 allele. Each engineered guide molecule is further designed such as to associate with a target genomic DNA sequence of interest that lies next to a protospacer adjacent motif (PAM), e.g., a PAM matching the sequence NGG or NAG, where "N" is any nucleobase. The guide sequences were designed to work in conjunction with one or more different CRISPR nucleases, including, but not limited to, e.g. SpCas9WT (PAM SEQ: NGG), SpCas9.VQR.1 (PAM SEQ: NGAN), SpCas9.VQR.2 (PAM SEQ: NGNG), SpCas9.EQR (PAM SEQ: NGAG), SpCas9.VRER (PAM SEQ: NGCG), SaCas9WT (PAM SEQ: NNGRRT), NmCas9WT (PAM SEQ: NNNNGATT), Cpf1 (PAM SEQ: TTTV), or JeCas9WT (PAM SEQ: NNNVRYM). RNA molecules of the present invention are each designed to form complexes in conjunction with one or more different CRISPR nucleases and designed to target polynucleotide sequences of interest utilizing one or more different PAM sequences respective to the CRISPR nuclease utilized.

TABLE 2

Guide sequences designed to associate with specific CXCR4 gene targets

| Target | SEQ ID NOs of 20 base guides | SEQ ID NOs of 21 base guides | SEQ ID NOs of 22 base guides |
|---|---|---|---|
| 2:136114901_C_A (c.1027G>T) | 1-46 | 47-94 | 95-144 |
| 2:136114901_C_T (c.1027G>A) | 1, 25, 27, 30-31, 38, 40, 145-183 | 71, 76-79, 86, 88, 184-224 | 107-108, 127-129, 136, 138, 225-267 |
| 2:136114910_CAG_C (c.1016_1017del) | 268-313 | 314-361 | 362-411 |
| 2:136114915_G_C (c.1013C>G) | 280, 412-456 | 319, 457-503 | 364, 504-552 |
| 2:136114915_G_T (c.1013C>A) | 280, 414, 417, 428, 430, 435, 451, 553-591 | 319, 459, 464, 474, 480, 482, 498, 592-632 | 364, 511, 521, 527, 529, 534, 548, 633-675 |
| 2:136114922_C_A (c.1006G>T) | 676-721 | 722-769 | 770-819 |
| 2:136114925_C_T (c.1003G>A) | 716, 820-864 | 736, 865-911 | 802, 912-960 |
| 2:136114928_G_A (c.1000C>T) | 830, 961-1005 | 869, 1006-1052 | 932, 1053-1101 |
| 2:136114934_C_A (c.994G>T) | 1102-1147 | 1148-1195 | 1196-1245 |
| 2:136115142_G_T (c.786C>A) | 1246-1291 | 1292-1339 | 1340-1389 |
| 2:136115201_T_G (c.727A>C) | 1390-1435 | 1436-1483 | 1484-1533 |
| 2:136115224_C_T (c.704G>A) | 1534-1579 | 1580-1627 | 1628-1677 |

TABLE 2-continued

Guide sequences designed to associate with specific CXCR4 gene targets

| Target | SEQ ID NOs of 20 base guides | SEQ ID NOs of 21 base guides | SEQ ID NOs of 22 base guides |
|---|---|---|---|
| 2:136115346_C_G (c.582G>C) | 1678-1723 | 1724-1771 | 1772-1821 |
| 2:136115422_A_G (c.506T>C) | 1822-1867 | 1868-1915 | 1916-1965 |
| 2:136115450_C_T (c.478G>A) | 1966-2011 | 2012-2059 | 2060-2109 |
| 2:136115470_T_G (c.458A>C) | 2110-2155 | 2156-2203 | 2204-2253 |
| 2:136115678_C_G (c.250G>C) | 2254-2299 | 2300-2347 | 2348-2397 |
| 2:136115678_C_T (c.250G>A) | 2257, 2260, 2262, 2268, 2273, 2282, 2286, 2398-2436 | 2302, 2304, 2307, 2309, 2315, 2329, 2340, 2437-2477 | 2350, 2352, 2355, 2363, 2371, 2385, 2390, 2478-2520 |
| 2:136115775_A_T (c.153T>A) | 2521-2566 | 2567-2614 | 2615-2664 |
| 2:136115926_A_T (c.16-14T>A) | 2665-2710 | 2711-2758 | 2759-2808 |
| 2:136112303_G_A rs2734871_REF | 2809-2854 | 2855-2902 | 2903-2952 |
| 2:136112303_G_A (rs2734871) SNP | 2809, 2821, 2826, 2828, 2835, 2842, 2845, 2953-2991 | 2864, 2867, 2869, 2874, 2876, 2883, 2893, 2992-3032 | 2908, 2913, 2916, 2923, 2932, 2942-2943, 3033-3075 |
| 2:136115979_A_T (rs2680880) REF | 3076-3077 | | 3078 |
| 2:136115979_A_T (rs2680880) SNP | 3076-3077 | | 3078 |
| 2:136116434_A_G (rs2471859) REF | 3079-3118 | 3119-3158 | 3159-3202 |
| 2:136116434_A_G (rs2471859)_SNP | 3098, 3101-3103, 3109, 3111, 3114, 3203-3241 | 3132, 3141-3143, 3149, 3151, 3154, 3242-3278 | 3174-3175, 3182, 3186-3187, 3195, 3198, 3279-3319 |
| 2:136117122_T_G_ (rs17848385) REF | 3320-3365 | 3366-3413 | 3414-3463 |
| 2:136117122_T_G (rs17848385) SNP | 3327-3328, 3338-3339, 3341, 3348, 3352, 3464-3502 | 3373, 3384, 3387, 3394-3395, 3399-3400, 3503-3543 | 3421-3422, 3433, 3436-3437, 3444, 3449, 3544-3586 |
| 2:136117336_G_A (rs11682928) REF | 3587-3630 | 3631-3665 | 3666-3707 |
| 2:136117336_G_A (rs11682928) SNP | 3587-3588, 3591, 3599, 3604, 3608, 3628, 3708-3746 | 3631-3633, 3636-3637, 3649, 3663, 3747-3787 | 3666-3668, 3672, 3676, 3687, 3689, 3788-3830 |
| 2:136117878_A_C (rs972851766) REF | 3831-3849 | 3850-3868 | 3869-3887 |
| 2:136117878_A_C (rs972851766) SNP | 3834-3835, 3837, 3845, 3849, 3888-3893 | 3853, 3855, 3857, 3864, 3868, 3894-3899 | 3869, 3871, 3873, 3875, 3877, 3900-3905 |
| 2:136117882_A_C (rs1260455777) REF | 3831-3834, 3836-3849, 3906-3913 | 3850-3863, 3865-3868, 3914-3921 | 3869-3870, 3872-3887, 3922-3929 |
| 2:136117882_A_C (rs1260455777) SNP | 3906, 3910, 3912-3913, 3930-3935 | 3914, 3919-3921, 3936-3941 | 3926-3929, 3942-3947 |
| 2:136117886_G_C (rs1179591969) REF | 3831-3834, 3836-3849, 3906-3913, 3948-3955 | 3850-3863, 3865-3868, 3914-3921, 3956-3963 | 3869-3870, 3872-3887, 3922-3929, 3964-3971 |
| 2:136117886_G_C (rs1179591969) SNP | 3951, 3953-3955, 3972-4001 | 3959, 3961-3963, 4002-4031 | 3968-3971, 4032-4061 |
| 2:136117888_A_C (rs1453114403) REF | 3831-3834, 3836-3849, 3906-3913, 3948-3955, 4062-4065 | 3850-3863, 3865-3868, 3914-3921, 3956-3963, 4066-4069 | 3869-3870, 3872-3887, 3922-3929, 3964-3971, 4070-4073 |
| 2:136117888_A_C (rs1453114403) SNP | 3953-3954, 4064-4065, 4074-4107 | 3962-3963, 4068-4069, 4108-4141 | 3970-3971, 4071, 4073, 4142-4175 |
| 2:136120697_C_T (rs62160906) REF | 4176-4217 | 4218-4259 | 4260-4303 |
| 2:136120697_C_T (rs62160906) SNP | 4199, 4201, 4212, 4304-4340 | 4240, 4252, 4254, 4341-4375 | 4271, 4284, 4296, 4376-4414 |

TABLE 2-continued

Guide sequences designed to associate with specific CXCR4 gene targets

| Target | SEQ ID NOs of 20 base guides | SEQ ID NOs of 21 base guides | SEQ ID NOs of 22 base guides |
| --- | --- | --- | --- |
| 2:136121046_C_G (rs9973445) REF | 4415-4458 | 4459-4486 | 4487-4526 |
| 2:136121046_C_G (rs9973445) SNP | 4421, 4427, 4434, 4440, 4442, 4527-4565 | 4465, 4477, 4566-4591 | 4492, 4498, 4510, 4592-4628 |
| 3' UTR (non-discrimintory) | 4629-5315 | 5316-5943 | 5944-6601 |

The indicated locations listed in column 1 of the Table 2 are based on gnomAD v3 database and UCSC Genome Browser assembly ID: hg38, Sequencing/Assembly provider ID: Genome Reference Consortium Human GRCh38.p12 (GCA_000001405.27). Assembly date: December 2013 initial release; December 2017 patch release 12.
The SNP details are indicated by the listed SNP ID Nos. ("rs numbers"), which are based on the NCBI 2018 database of Single Nucleotide Polymorphisms (dbSNP)). The indicated DNA mutations are associated with Transcript Consequence NM_003467.3.

Each embodiment disclosed herein is contemplated as being applicable to each of the other disclosed embodiment. For example, it is understood that any of the RNA molecules or compositions of the present invention may be utilized in any of the methods of the present invention.

REFERENCES

1. Ahmad and Allen (1992) "Antibody-mediated Specific Binging and Cytotoxicity of Liposome-entrapped Doxorubicin to Lung Cancer Cells in Vitro", Cancer Research 52:4817-20
2. Anderson (1992) "Human gene therapy", Science 256: 808-13
3. Basha et al. (2011) "Influence of Cationic Lipid Composition on Gene Silencing Properties of Lipid Nanoparticle Formulations of siRNA in Antigen-Presenting Cells", Mol. Ther. 19(12):2186-200
4. Behr (1994) Gene transfer with synthetic cationic amphiphiles: Prospects for gene therapy", Bioconjugate Chem 5:382-89
5. Blaese (1995) "Vectors in cancer therapy: how will they deliver", Cancer Gene Ther. 2:291-97
6. Blaese et al. (1995) "T lymphocyte-directed gene therapy for ADA-SKID: initial trial results after 4 years", Science 270(5235):475-80
7. Buchschacher and Panganiban (1992) "Human immunodeficiency virus vectors for inducible expression of foreign genes", J. Virol. 66:2731-39
8. Burstein et al. (2017) "New CRISPR-Cas systems from uncultivated microbes", Nature 542:237-41
9. Chung et al. (2006) "*Agrobacterium* is not alone: gene transfer to plants by viruses and other bacteria", Trends Plant Sci. 11(1):1-4
10. Coelho et al. (2013) "Safety and Efficacy of RNAi Therapy for Transthyretin Amyloidosis", N Engl J. Med 369:819-29
11. Crystal (1995) "Transfer of genes to humans: early lessons and obstacles to success", Science 270(5235):404-10
12. Dillon (1993) "Regulation gene expression in gene therapy" Trends in Biotechnology 11(5):167-173
13. Dranoff et al. (1997) "A phase I study of vaccination with autologous, irradiated melanoma cells engineered to secrete human granulocyte macrophage colony stimulating factor", Hum. Gene Ther. 8(1):111-23
14. Dunbar et al. (1995) "Retrovirally marked CD34-enriched peripheral blood and bone marrow cells contribute to long-term engraftment after autologous transplantation", Blood 85:3048-57
15. Ellem et al. (1997) "A case report: immune responses and clinical course of the first human use of granulocyte/macrophage-colony-stimulating-factor-tranduced autologous melanoma cells for immunotherapy", Cancer Immunol Immunother 44:10-20
16. Gao and Huang (1995) "Cationic liposome-mediated gene transfer" Gene Ther. 2(10):710-22
17. Haddada et al. (1995) "Gene Therapy Using Adenovirus Vectors", in: The Molecular Repertoire of Adenoviruses III: Biology and Pathogenesis, ed. Doerfler and Bohm, pp. 297-306
18. Han et al. (1995) "Ligand-directed retro-viral targeting of human breast cancer cells", Proc Natl Acad Sci U.S.A. 92(21):9747-51
19. Inaba et al. (1992) "Generation of large numbers of dendritic cells from mouse bone marrow cultures supplemented with granulocyte/macrophage colony-stimulating factor", J Exp Med. 176(6):1693-702
20. Jinek et al. (2012) "A programmable dual-RNA-guided DNA endonuclease in adaptive bacterial immunity," Science 337(6096):816-21
21. Johan et al. (1992) "GLVR1, a receptor for gibbon ape leukemia virus, is homologous to a phosphate permease of *Neurospora crassa* and is expressed at high levels in the brain and thymus", J Virol 66(3):1635-40
22. Judge et al. (2006) "Design of noninflammatory synthetic siRNA mediating potent gene silencing in vivo", Mol Ther. 13(3):494-505
23. Kohn et al. (1995) "Engraftment of gene-modified umbilical cord blood cells in neonates with adenosine deaminase deficiency", Nature Medicine 1:1017-23
24. Kremer and Perricaudet (1995) "Adenovirus and adeno-associated virus mediated gene transfer", Br. Med. Bull. 51(1):31-44
25. Macdiarmid et al. (2009) "Sequential treatment of drug-resistant tumors with targeted minicells containing siRNA or a cytotoxic drug", Nat Biotechnol. 27(7):643-51
26. Malech et al. (1997) "Prolonged production of NADPH oxidase-corrected granulocytes after gene therapy of chronic granulomatous disease", PNAS 94(22):12133-38
27. Miller et al. (1991) "Construction and properties of retrovirus packaging cells based on gibbon ape leukemia virus", J Virol. 65(5):2220-24

28. Miller (1992) "Human gene therapy comes of age", Nature 357:455-60
29. Mitani and Caskey (1993) "Delivering therapeutic genes—matching approach and application", Trends in Biotechnology 11(5):162-66
30. Nabel and Felgner (1993) "Direct gene transfer for immunotherapy and immunization", Trends in Biotechnology 11(5):211-15
31. Remy et al. (1994) "Gene Transfer with a Series of Lipophilic DNA-Binding Molecules", Bioconjugate Chem. 5(6):647-54
32. Sentmanat et al. (2018) "A Survey of Validation Strategies for CRISPR-Cas9 Editing", Scientific Reports 8:888, doi:10.1038/s41598-018-19441-8
33. Sommerfelt et al. (1990) "Localization of the receptor gene for type D simian retroviruses on human chromosome 19", J. Virol. 64(12):6214-20
34. Van Brunt (1988) "Molecular framing: transgenic animals as bioactors" Biotechnology 6:1149-54
35. Vigne et al. (1995) "Third-generation adenovectors for gene therapy", Restorative Neurology and Neuroscience 8(1,2): 35-36
36. Weissman and Kariko (2015) "mRNA: Fulfilling the promise of gene therapy", Molecular Therapy (9):1416-7.
37. Wilson et al. (1989) "Formation of infectious hybrid virion with gibbon ape leukemia virus and human T-cell leukemia virus retroviral envelope glycoproteins and the gag and pol proteins of Moloney murine leukemia virus", J. Virol. 63:2374-78
38. Yu et al. (1994) "Progress towards gene therapy for HIV infection", Gene Ther. 1(1):13-26
39. Zetsche et al. (2015) "Cpf1 is a single RNA-guided endonuclease of a class 2 CRIPSR-Cas system" Cell 163(3):759-71
40. Zuris et al. (2015) "Cationic lipid-mediated delivery of proteins enables efficient protein based genome editing in vitro and in vivo" Nat Biotechnol. 33(1):73-80 wherein a complex of the CRISPR nuclease and the second RNA molecule affects a double strand break in the 3' UTR of both the functional and mutant CXCR4 alleles, and wherein following the double strand break in the mutant allele of the CXCR4 gene and the double strand break in the 3' UTR of both the functional and mutant CXCR4 alleles, the CXCR4 gene of the cell expresses only the functional CXCR4 protein, wherein the first RNA molecule targets the CRISPR nuclease to a SNP position of the mutant allele, and wherein the SNP position is in a non-coding region of the CXCR4 mutant allele.

2. The method of claim 1, wherein the guide sequence portion of the first RNA molecule comprises 17-25 contiguous nucleotides containing nucleotides in the sequence set forth in any one of SEQ ID NOs: 3587-3830 that targets a SNP position of the mutant allele.

3. The method of claim 1, wherein the non-coding region is any one of a promoter region, 5' UTR, or an intron.

4. The method of claim 1, wherein a portion of the CXCR4 mutant allele is excised by the first and second RNA molecules.

5. The method of claim 1, wherein the first RNA molecule targets a SNP position in an intron of the mutant CXCR4 allele.

6. The method of claim 1, wherein the guide sequence portion of the second RNA molecule comprises 17-25 contiguous nucleotides containing nucleotides in the sequence set forth in any one of SEQ ID NOs: 4629-6601.

7. The method of claim 1, wherein the second RNA molecule comprises a guide sequence portion that targets a sequence up to 500 basepairs from a CXCR4 polyadenylation sequence.

SEQUENCE LISTING (6606 sequences)

SEQ ID NO: 1 - RNA, 20 nt, Artificial Sequence
  CXCR4 targeting guide RNA
aaaacuugaagacucagacu

SEQ ID NO: 2 - RNA, 20 nt, Artificial Sequence
  CXCR4 targeting guide RNA
aaacuugaagacucagacua

SEQ ID NO: 3 - RNA, 20 nt, Artificial Sequence
  CXCR4 targeting guide RNA
aacuugaagacucagacuaa

SEQ ID NO: 4 - RNA, 20 nt, Artificial Sequence
  CXCR4 targeting guide RNA
aagacucagacuaaguggaa

SEQ ID NO: 5 - RNA, 20 nt, Artificial Sequence
  CXCR4 targeting guide RNA
aaguggaaacagaugaaugu

SEQ ID NO: 6 - RNA, 20 nt, Artificial Sequence
  CXCR4 targeting guide RNA
acauucaucuguuuccacuu

SEQ ID NO: 7 - RNA, 20 nt, Artificial Sequence
  CXCR4 targeting guide RNA
acuaaguggaaacagaugaa

SEQ ID NO: 8 - RNA, 20 nt, Artificial Sequence
  CXCR4 targeting guide RNA
acucagacuaaguggaaaca

SEQ ID NO: 9 - RNA, 20 nt, Artificial Sequence
  CXCR4 targeting guide RNA
acuuagucugagucuucaag

SEQ ID NO: 10 - RNA, 20 nt, Artificial Sequence
  CXCR4 targeting guide RNA
acuugaagacucagacuaag

SEQ ID NO: 11 - RNA, 20 nt, Artificial Sequence
  CXCR4 targeting guide RNA
agacuaaguggaaacagaug

SEQ ID NO: 12 - RNA, 20 nt, Artificial Sequence
  CXCR4 targeting guide RNA
agacucagacuaaguggaaa

SEQ ID NO: 13 - RNA, 20 nt, Artificial Sequence
  CXCR4 targeting guide RNA
aucuguuuccacuuagucug

SEQ ID NO: 14 - RNA, 20 nt, Artificial Sequence
  CXCR4 targeting guide RNA
auucaucuguuuccacuuag

SEQ ID NO: 15 - RNA, 20 nt, Artificial Sequence
  CXCR4 targeting guide RNA
cacuuagucugagucuucaa

SEQ ID NO: 16 - RNA, 20 nt, Artificial Sequence
  CXCR4 targeting guide RNA
cagacuaaguggaaacagau

SEQ ID NO: 17 - RNA, 20 nt, Artificial Sequence
  CXCR4 targeting guide RNA
caucuguuuccacuuagucu

SEQ ID NO: 18 - RNA, 20 nt, Artificial Sequence
  CXCR4 targeting guide RNA
cauucaucuguuuccacuua

SEQ ID NO: 19 - RNA, 20 nt, Artificial Sequence
  CXCR4 targeting guide RNA
ccacuuagucugagucuuca

SEQ ID NO: 20 - RNA, 20 nt, Artificial Sequence
  CXCR4 targeting guide RNA
cuaaguggaaacagaugaau

SEQ ID NO: 21 - RNA, 20 nt, Artificial Sequence
  CXCR4 targeting guide RNA
cucagacuaaguggaaacag

SEQ ID NO: 22 - RNA, 20 nt, Artificial Sequence
  CXCR4 targeting guide RNA
cuguuuccacuuagucugag

SEQ ID NO: 23 - RNA, 20 nt, Artificial Sequence
  CXCR4 targeting guide RNA
cuuagucugagucuucaagu

SEQ ID NO: 24 - RNA, 20 nt, Artificial Sequence
  CXCR4 targeting guide RNA
cuugaagacucagacuaagu

SEQ ID NO: 25 - RNA, 20 nt, Artificial Sequence
  CXCR4 targeting guide RNA
gaaaacuugaagacucagac

SEQ ID NO: 26 - RNA, 20 nt, Artificial Sequence
  CXCR4 targeting guide RNA
gaagacucagacuaagugga

SEQ ID NO: 27 - RNA, 20 nt, Artificial Sequence
  CXCR4 targeting guide RNA
gacauucaucuguuuccacu

SEQ ID NO: 28 - RNA, 20 nt, Artificial Sequence
  CXCR4 targeting guide RNA
gacuaaguggaaacagauga

SEQ ID NO: 29 - RNA, 20 nt, Artificial Sequence
  CXCR4 targeting guide RNA
gacucagacuaaguggaaac

SEQ ID NO: 30 - RNA, 20 nt, Artificial Sequence
  CXCR4 targeting guide RNA
ggacauucaucuguuuccac

SEQ ID NO: 31 - RNA, 20 nt, Artificial Sequence
  CXCR4 targeting guide RNA
guggacauucaucuguuucc

SEQ ID NO: 32 - RNA, 20 nt, Artificial Sequence
  CXCR4 targeting guide RNA
guuuccacuuagucugaguc

SEQ ID NO: 33 - RNA, 20 nt, Artificial Sequence
  CXCR4 targeting guide RNA
uaaguggaaacagaugaaug

SEQ ID NO: 34 - RNA, 20 nt, Artificial Sequence
  CXCR4 targeting guide RNA
ucagacuaaguggaaacaga

SEQ ID NO: 35 - RNA, 20 nt, Artificial Sequence
  CXCR4 targeting guide RNA
ucaucuguuuccacuuaguc

SEQ ID NO: 36 - RNA, 20 nt, Artificial Sequence
  CXCR4 targeting guide RNA
uccacuuagucugagucuuc

SEQ ID NO: 37 - RNA, 20 nt, Artificial Sequence
  CXCR4 targeting guide RNA
ucuguuuccacuuagucuga

SEQ ID NO: 38 - RNA, 20 nt, Artificial Sequence
  CXCR4 targeting guide RNA
ugaaaacuugaagacucaga

SEQ ID NO: 39 - RNA, 20 nt, Artificial Sequence
  CXCR4 targeting guide RNA
ugaagacucagacuaagugg

SEQ ID NO: 40 - RNA, 20 nt, Artificial Sequence
  CXCR4 targeting guide RNA
uggacauucaucuguuucca

SEQ ID NO: 41 - RNA, 20 nt, Artificial Sequence
  CXCR4 targeting guide RNA
uguuuccacuuagucugagu

SEQ ID NO: 42 - RNA, 20 nt, Artificial Sequence
  CXCR4 targeting guide RNA
uuagucugagucuucaaguu

SEQ ID NO: 43 - RNA, 20 nt, Artificial Sequence
  CXCR4 targeting guide RNA
uucaucuguuuccacuuagu

SEQ ID NO: 44 - RNA, 20 nt, Artificial Sequence
  CXCR4 targeting guide RNA
uuccacuuagucugagucuu

SEQ ID NO: 45 - RNA, 20 nt, Artificial Sequence
  CXCR4 targeting guide RNA
uugaagacucagacuaagug

SEQ ID NO: 46 - RNA, 20 nt, Artificial Sequence
  CXCR4 targeting guide RNA
uuuccacuuagucugagucu

SEQ ID NO: 47 - RNA, 21 nt, Artificial Sequence
  CXCR4 targeting guide RNA
aaaacuugaagacucagacua

SEQ ID NO: 48 - RNA, 21 nt, Artificial Sequence
  CXCR4 targeting guide RNA
aaacuugaagacucagacuaa

SEQ ID NO: 49 - RNA, 21 nt, Artificial Sequence
  CXCR4 targeting guide RNA
aacuugaagacucagacuaag

SEQ ID NO: 50 - RNA, 21 nt, Artificial Sequence
  CXCR4 targeting guide RNA
aagacucagacuaaguggaaa

SEQ ID NO: 51 - RNA, 21 nt, Artificial Sequence
  CXCR4 targeting guide RNA
aaguggaaacagaugaauguc

SEQ ID NO: 52 - RNA, 21 nt, Artificial Sequence
  CXCR4 targeting guide RNA
acauucaucuguuuccacuua

SEQ ID NO: 53 - RNA, 21 nt, Artificial Sequence
  CXCR4 targeting guide RNA
acuaaguggaaacagaugaau

SEQ ID NO: 54 - RNA, 21 nt, Artificial Sequence
  CXCR4 targeting guide RNA
acucagacuaaguggaaacag

SEQ ID NO: 55 - RNA, 21 nt, Artificial Sequence
  CXCR4 targeting guide RNA
acuuagucugagucuucaagu

SEQ ID NO: 56 - RNA, 21 nt, Artificial Sequence
  CXCR4 targeting guide RNA
acuugaagacucagacuaagu

SEQ ID NO: 57 - RNA, 21 nt, Artificial Sequence
  CXCR4 targeting guide RNA
agacuaaguggaaacagauga

SEQ ID NO: 58 - RNA, 21 nt, Artificial Sequence
  CXCR4 targeting guide RNA
agacucagacuaaguggaaac

SEQ ID NO: 59 - RNA, 21 nt, Artificial Sequence
  CXCR4 targeting guide RNA
aucuguuuccacuuagucuga

SEQ ID NO: 60 - RNA, 21 nt, Artificial Sequence
  CXCR4 targeting guide RNA
auucaucuguuuccacuuagu

SEQ ID NO: 61 - RNA, 21 nt, Artificial Sequence
  CXCR4 targeting guide RNA
cacuuagucugagucuucaag

SEQ ID NO: 62 - RNA, 21 nt, Artificial Sequence
  CXCR4 targeting guide RNA
cagacuaaguggaaacagaug

SEQ ID NO: 63 - RNA, 21 nt, Artificial Sequence
  CXCR4 targeting guide RNA
caucuguuuccacuuagucug

SEQ ID NO: 64 - RNA, 21 nt, Artificial Sequence
  CXCR4 targeting guide RNA
cauucaucuguuuccacuuag

SEQ ID NO: 65 - RNA, 21 nt, Artificial Sequence
  CXCR4 targeting guide RNA
ccacuuagucugagucuucaa

SEQ ID NO: 66 - RNA, 21 nt, Artificial Sequence
  CXCR4 targeting guide RNA
cuaaguggaaacagaugaaug

SEQ ID NO: 67 - RNA, 21 nt, Artificial Sequence
  CXCR4 targeting guide RNA
cucagacuaaguggaaacaga

SEQ ID NO: 68 - RNA, 21 nt, Artificial Sequence
  CXCR4 targeting guide RNA
cuguuuccacuuagucugagu

SEQ ID NO: 69 - RNA, 21 nt, Artificial Sequence
  CXCR4 targeting guide RNA
cuuagucugagucuucaaguu

SEQ ID NO: 70 - RNA, 21 nt, Artificial Sequence
  CXCR4 targeting guide RNA
cuugaagacucagacuaagug

SEQ ID NO: 71 - RNA, 21 nt, Artificial Sequence
  CXCR4 targeting guide RNA
gaaaacuugaagacucagacu

SEQ ID NO: 72 - RNA, 21 nt, Artificial Sequence
  CXCR4 targeting guide RNA
gaagacucagacuaaguggaa

SEQ ID NO: 73 - RNA, 21 nt, Artificial Sequence
  CXCR4 targeting guide RNA
gacauucaucuguuuccacuu

SEQ ID NO: 74 - RNA, 21 nt, Artificial Sequence
  CXCR4 targeting guide RNA
gacuaaguggaaacagaugaa

SEQ ID NO: 75 - RNA, 21 nt, Artificial Sequence
  CXCR4 targeting guide RNA
gacucagacuaaguggaaaca

SEQ ID NO: 76 - RNA, 21 nt, Artificial Sequence
  CXCR4 targeting guide RNA
ggacauucaucuguuuccacu

SEQ ID NO: 77 - RNA, 21 nt, Artificial Sequence
  CXCR4 targeting guide RNA
gguggacauucaucuguuucc

SEQ ID NO: 78 - RNA, 21 nt, Artificial Sequence
  CXCR4 targeting guide RNA
gugaaaacuugaagacucaga

SEQ ID NO: 79 - RNA, 21 nt, Artificial Sequence
  CXCR4 targeting guide RNA
guggacauucaucuguuucca

SEQ ID NO: 80 - RNA, 21 nt, Artificial Sequence
  CXCR4 targeting guide RNA
guuuccacuuagucugagucu

SEQ ID NO: 81 - RNA, 21 nt, Artificial Sequence
  CXCR4 targeting guide RNA
uaaguggaaacagaugaaugu

SEQ ID NO: 82 - RNA, 21 nt, Artificial Sequence
  CXCR4 targeting guide RNA
ucagacuaaguggaaacagau

SEQ ID NO: 83 - RNA, 21 nt, Artificial Sequence
  CXCR4 targeting guide RNA
ucaucuguuuccacuuagucu

SEQ ID NO: 84 - RNA, 21 nt, Artificial Sequence
  CXCR4 targeting guide RNA
uccacuuagucugagucuuca

SEQ ID NO: 85 - RNA, 21 nt, Artificial Sequence
  CXCR4 targeting guide RNA
ucuguuuccacuuagucugag

SEQ ID NO: 86 - RNA, 21 nt, Artificial Sequence
  CXCR4 targeting guide RNA
ugaaaacuugaagacucagac

SEQ ID NO: 87 - RNA, 21 nt, Artificial Sequence
  CXCR4 targeting guide RNA
ugaagacucagacuaagugga

SEQ ID NO: 88 - RNA, 21 nt, Artificial Sequence
  CXCR4 targeting guide RNA
uggacauucaucuguuuccac

SEQ ID NO: 89 - RNA, 21 nt, Artificial Sequence
  CXCR4 targeting guide RNA
uguuuccacuuagucugaguc

SEQ ID NO: 90 - RNA, 21 nt, Artificial Sequence
  CXCR4 targeting guide RNA
uuagucugagucuucaaguuu

SEQ ID NO: 91 - RNA, 21 nt, Artificial Sequence
  CXCR4 targeting guide RNA
uucaucuguuuccacuuaguc

SEQ ID NO: 92 - RNA, 21 nt, Artificial Sequence
  CXCR4 targeting guide RNA
uuccacuuagucugagucuuc

SEQ ID NO: 93 - RNA, 21 nt, Artificial Sequence
  CXCR4 targeting guide RNA
uugaagacucagacuaagugg

SEQ ID NO: 94 - RNA, 21 nt, Artificial Sequence
  CXCR4 targeting guide RNA
uuuccacuuagucugagucuu

SEQ ID NO: 95 - RNA, 22 nt, Artificial Sequence
  CXCR4 targeting guide RNA
aaaacuugaagacucagacuaa

SEQ ID NO: 96 - RNA, 22 nt, Artificial Sequence
  CXCR4 targeting guide RNA
aaacuugaagacucagacuaag

SEQ ID NO: 97 - RNA, 22 nt, Artificial Sequence
  CXCR4 targeting guide RNA
aacuugaagacucagacuaagu

SEQ ID NO: 98 - RNA, 22 nt, Artificial Sequence
  CXCR4 targeting guide RNA
aagacucagacuaaguggaaac

SEQ ID NO: 99 - RNA, 22 nt, Artificial Sequence
  CXCR4 targeting guide RNA
aaguggaaacagaugaaugucc

SEQ ID NO: 100 - RNA, 22 nt, Artificial Sequence
  CXCR4 targeting guide RNA
acauucaucuguuuccacuuag

SEQ ID NO: 101 - RNA, 22 nt, Artificial Sequence
  CXCR4 targeting guide RNA
acuaaguggaaacagaugaaug

SEQ ID NO: 102 - RNA, 22 nt, Artificial Sequence
  CXCR4 targeting guide RNA
acucagacuaaguggaaacaga

SEQ ID NO: 103 - RNA, 22 nt, Artificial Sequence
  CXCR4 targeting guide RNA
acuuagucugagucuucaaguu

SEQ ID NO: 104 - RNA, 22 nt, Artificial Sequence
  CXCR4 targeting guide RNA
acuugaagacucagacuaagug

SEQ ID NO: 105 - RNA, 22 nt, Artificial Sequence
  CXCR4 targeting guide RNA
agacuaaguggaaacagaugaa

SEQ ID NO: 106 - RNA, 22 nt, Artificial Sequence
  CXCR4 targeting guide RNA
agacucagacuaaguggaaaca

SEQ ID NO: 107 - RNA, 22 nt, Artificial Sequence
  CXCR4 targeting guide RNA
agguggacauucaucuguuucc

SEQ ID NO: 108 - RNA, 22 nt, Artificial Sequence
  CXCR4 targeting guide RNA
agugaaaacuugaagacucaga

SEQ ID NO: 109 - RNA, 22 nt, Artificial Sequence
  CXCR4 targeting guide RNA
aucuguuuccacuuagucugag

SEQ ID NO: 110 - RNA, 22 nt, Artificial Sequence
  CXCR4 targeting guide RNA
auucaucuguuuccacuuaguc

SEQ ID NO: 111 - RNA, 22 nt, Artificial Sequence
  CXCR4 targeting guide RNA
cacuuagucugagucuucaagu

SEQ ID NO: 112 - RNA, 22 nt, Artificial Sequence
  CXCR4 targeting guide RNA
cagacuaaguggaaacagauga

SEQ ID NO: 113 - RNA, 22 nt, Artificial Sequence
  CXCR4 targeting guide RNA
caucuguuuccacuuagucuga

SEQ ID NO: 114 - RNA, 22 nt, Artificial Sequence
  CXCR4 targeting guide RNA
cauucaucuguuuccacuuagu

SEQ ID NO: 115 - RNA, 22 nt, Artificial Sequence
  CXCR4 targeting guide RNA
ccacuuagucugagucuucaag

SEQ ID NO: 116 - RNA, 22 nt, Artificial Sequence
  CXCR4 targeting guide RNA
cuaaguggaaacagaugaaugu

SEQ ID NO: 117 - RNA, 22 nt, Artificial Sequence
  CXCR4 targeting guide RNA
cucagacuaaguggaaacagau

SEQ ID NO: 118 - RNA, 22 nt, Artificial Sequence
  CXCR4 targeting guide RNA
cuguuuccacuuagucugaguc

SEQ ID NO: 119 - RNA, 22 nt, Artificial Sequence
  CXCR4 targeting guide RNA
cuuagucugagucuucaaguuu

SEQ ID NO: 120 - RNA, 22 nt, Artificial Sequence
  CXCR4 targeting guide RNA
cuugaagacucagacuaagugg

SEQ ID NO: 121 - RNA, 22 nt, Artificial Sequence
  CXCR4 targeting guide RNA
gaaaacuugaagacucagacua

SEQ ID NO: 122 - RNA, 22 nt, Artificial Sequence
  CXCR4 targeting guide RNA
gaagacucagacuaaguggaaa

SEQ ID NO: 123 - RNA, 22 nt, Artificial Sequence
  CXCR4 targeting guide RNA
gacauucaucuguuuccacuua

SEQ ID NO: 124 - RNA, 22 nt, Artificial Sequence
  CXCR4 targeting guide RNA
gacuaaguggaaacagaugaau

SEQ ID NO: 125 - RNA, 22 nt, Artificial Sequence
  CXCR4 targeting guide RNA
gacucagacuaaguggaaacag

SEQ ID NO: 126 - RNA, 22 nt, Artificial Sequence
  CXCR4 targeting guide RNA
ggacauucaucuguuuccacuu

SEQ ID NO: 127 - RNA, 22 nt, Artificial Sequence
  CXCR4 targeting guide RNA
gguggacauucaucuguuucca

SEQ ID NO: 128 - RNA, 22 nt, Artificial Sequence
  CXCR4 targeting guide RNA
gugaaaacuugaagacucagac

SEQ ID NO: 129 - RNA, 22 nt, Artificial Sequence
  CXCR4 targeting guide RNA
guggacauucaucuguuuccac

SEQ ID NO: 130 - RNA, 22 nt, Artificial Sequence
  CXCR4 targeting guide RNA
guuuccacuuagucugagucuu

SEQ ID NO: 131 - RNA, 22 nt, Artificial Sequence
  CXCR4 targeting guide RNA
uaaguggaaacagaugaauguc

SEQ ID NO: 132 - RNA, 22 nt, Artificial Sequence
  CXCR4 targeting guide RNA
ucagacuaaguggaaacagaug

SEQ ID NO: 133 - RNA, 22 nt, Artificial Sequence
  CXCR4 targeting guide RNA
ucaucuguuuccacuuagucug

SEQ ID NO: 134 - RNA, 22 nt, Artificial Sequence
  CXCR4 targeting guide RNA
uccacuuagucugagucuucaa

SEQ ID NO: 135 - RNA, 22 nt, Artificial Sequence
  CXCR4 targeting guide RNA
ucuguuuccacuuagucugagu

SEQ ID NO: 136 - RNA, 22 nt, Artificial Sequence
  CXCR4 targeting guide RNA
ugaaaacuugaagacucagacu

SEQ ID NO: 137 - RNA, 22 nt, Artificial Sequence
  CXCR4 targeting guide RNA
ugaagacucagacuaaguggaa

SEQ ID NO: 138 - RNA, 22 nt, Artificial Sequence
  CXCR4 targeting guide RNA
uggacauucaucuguuuccacu

SEQ ID NO: 139 - RNA, 22 nt, Artificial Sequence
  CXCR4 targeting guide RNA
uguuuccacuuagucugagucu

SEQ ID NO: 140 - RNA, 22 nt, Artificial Sequence
  CXCR4 targeting guide RNA
uuagucugagucuucaaguuuu

SEQ ID NO: 141 - RNA, 22 nt, Artificial Sequence
  CXCR4 targeting guide RNA
uucaucuguuuccacuuagucu

SEQ ID NO: 142 - RNA, 22 nt, Artificial Sequence
  CXCR4 targeting guide RNA
uuccacuuagucugagucuuca

SEQ ID NO: 143 - RNA, 22 nt, Artificial Sequence
  CXCR4 targeting guide RNA
uugaagacucagacuaagugga

SEQ ID NO: 144 - RNA, 22 nt, Artificial Sequence
  CXCR4 targeting guide RNA
uuuccacuuagucugagucuuc

SEQ ID NO: 145 - RNA, 20 nt, Artificial Sequence
  CXCR4 targeting guide RNA
aaacuugaagacucagacuu

SEQ ID NO: 146 - RNA, 20 nt, Artificial Sequence
  CXCR4 targeting guide RNA
aacuugaagacucagacuua

SEQ ID NO: 147 - RNA, 20 nt, Artificial Sequence
  CXCR4 targeting guide RNA
aagacucagacuuaguggaa

SEQ ID NO: 148 - RNA, 20 nt, Artificial Sequence
  CXCR4 targeting guide RNA
acauucaucuguuuccacua

SEQ ID NO: 149 - RNA, 20 nt, Artificial Sequence
  CXCR4 targeting guide RNA
acuaagucugagucuucaag

SEQ ID NO: 150 - RNA, 20 nt, Artificial Sequence
  CXCR4 targeting guide RNA
acucagacuuaguggaaaca

SEQ ID NO: 151 - RNA, 20 nt, Artificial Sequence
  CXCR4 targeting guide RNA
acuuaguggaaacagaugaa

SEQ ID NO: 152 - RNA, 20 nt, Artificial Sequence
  CXCR4 targeting guide RNA
acuugaagacucagacuuag

SEQ ID NO: 153 - RNA, 20 nt, Artificial Sequence
  CXCR4 targeting guide RNA
agacucagacuuaguggaaa

SEQ ID NO: 154 - RNA, 20 nt, Artificial Sequence
  CXCR4 targeting guide RNA
agacuuaguggaaacagaug

SEQ ID NO: 155 - RNA, 20 nt, Artificial Sequence
  CXCR4 targeting guide RNA
aucuguuuccacuaagucug

SEQ ID NO: 156 - RNA, 20 nt, Artificial Sequence
  CXCR4 targeting guide RNA
auucaucuguuuccacuaag

SEQ ID NO: 157 - RNA, 20 nt, Artificial Sequence
  CXCR4 targeting guide RNA
cacuaagucugagucuucaa

SEQ ID NO: 158 - RNA, 20 nt, Artificial Sequence
  CXCR4 targeting guide RNA
cagacuuaguggaaacagau

SEQ ID NO: 159 - RNA, 20 nt, Artificial Sequence
  CXCR4 targeting guide RNA
caucuguuuccacuaagucu

SEQ ID NO: 160 - RNA, 20 nt, Artificial Sequence
  CXCR4 targeting guide RNA
cauucaucuguuuccacuaa

SEQ ID NO: 161 - RNA, 20 nt, Artificial Sequence
  CXCR4 targeting guide RNA
ccacuaagucugagucuuca

SEQ ID NO: 162 - RNA, 20 nt, Artificial Sequence
  CXCR4 targeting guide RNA
cuaagucugagucuucaagu

SEQ ID NO: 163 - RNA, 20 nt, Artificial Sequence
  CXCR4 targeting guide RNA
cucagacuuaguggaaacag

SEQ ID NO: 164 - RNA, 20 nt, Artificial Sequence
  CXCR4 targeting guide RNA
cuguuuccacuaagucugag

SEQ ID NO: 165 - RNA, 20 nt, Artificial Sequence
  CXCR4 targeting guide RNA
cuuaguggaaacagaugaau

SEQ ID NO: 166 - RNA, 20 nt, Artificial Sequence
  CXCR4 targeting guide RNA
cuugaagacucagacuuagu

SEQ ID NO: 167 - RNA, 20 nt, Artificial Sequence
  CXCR4 targeting guide RNA
gaagacucagacuuagugga

SEQ ID NO: 168 - RNA, 20 nt, Artificial Sequence
  CXCR4 targeting guide RNA
gacucagacuuaguggaaac

SEQ ID NO: 169 - RNA, 20 nt, Artificial Sequence
  CXCR4 targeting guide RNA
gacuuaguggaaacagauga

SEQ ID NO: 170 - RNA, 20 nt, Artificial Sequence
  CXCR4 targeting guide RNA
guuuccacuaagucugaguc

SEQ ID NO: 171 - RNA, 20 nt, Artificial Sequence
  CXCR4 targeting guide RNA
uaagucugagucuucaaguu

SEQ ID NO: 172 - RNA, 20 nt, Artificial Sequence
  CXCR4 targeting guide RNA
uaguggaaacagaugaaugu

SEQ ID NO: 173 - RNA, 20 nt, Artificial Sequence
  CXCR4 targeting guide RNA
ucagacuuaguggaaacaga

SEQ ID NO: 174 - RNA, 20 nt, Artificial Sequence
  CXCR4 targeting guide RNA
ucaucuguuuccacuaaguc

SEQ ID NO: 175 - RNA, 20 nt, Artificial Sequence
  CXCR4 targeting guide RNA
uccacuaagucugagucuuc

SEQ ID NO: 176 - RNA, 20 nt, Artificial Sequence
  CXCR4 targeting guide RNA
ucuguuuccacuaagucuga

SEQ ID NO: 177 - RNA, 20 nt, Artificial Sequence
  CXCR4 targeting guide RNA
ugaagacucagacuuagugg

SEQ ID NO: 178 - RNA, 20 nt, Artificial Sequence
  CXCR4 targeting guide RNA
uguuuccacuaagucugagu

SEQ ID NO: 179 - RNA, 20 nt, Artificial Sequence
  CXCR4 targeting guide RNA
uuaguggaaacagaugaaug

SEQ ID NO: 180 - RNA, 20 nt, Artificial Sequence
  CXCR4 targeting guide RNA
uucaucuguuuccacuaagu

SEQ ID NO: 181 - RNA, 20 nt, Artificial Sequence
  CXCR4 targeting guide RNA
uuccacuaagucugagucuu

SEQ ID NO: 182 - RNA, 20 nt, Artificial Sequence
  CXCR4 targeting guide RNA
uugaagacucagacuuagug

SEQ ID NO: 183 - RNA, 20 nt, Artificial Sequence
  CXCR4 targeting guide RNA
uuuccacuaagucugagucu

SEQ ID NO: 184 - RNA, 21 nt, Artificial Sequence
  CXCR4 targeting guide RNA
aaaacuugaagacucagacuu

SEQ ID NO: 185 - RNA, 21 nt, Artificial Sequence
  CXCR4 targeting guide RNA
aaacuugaagacucagacuua

SEQ ID NO: 186 - RNA, 21 nt, Artificial Sequence
  CXCR4 targeting guide RNA
aacuugaagacucagacuuag

SEQ ID NO: 187 - RNA, 21 nt, Artificial Sequence
  CXCR4 targeting guide RNA
aagacucagacuuaguggaaa

SEQ ID NO: 188 - RNA, 21 nt, Artificial Sequence
  CXCR4 targeting guide RNA
acauucaucuguuuccacuaa

SEQ ID NO: 189 - RNA, 21 nt, Artificial Sequence
  CXCR4 targeting guide RNA
acuaagucugagucuucaagu

SEQ ID NO: 190 - RNA, 21 nt, Artificial Sequence
  CXCR4 targeting guide RNA
acucagacuuaguggaaacag

SEQ ID NO: 191 - RNA, 21 nt, Artificial Sequence
  CXCR4 targeting guide RNA
acuuaguggaaacagaugaau

SEQ ID NO: 192 - RNA, 21 nt, Artificial Sequence
  CXCR4 targeting guide RNA
acuugaagacucagacuuagu

SEQ ID NO: 193 - RNA, 21 nt, Artificial Sequence
  CXCR4 targeting guide RNA
agacucagacuuaguggaaac

SEQ ID NO: 194 - RNA, 21 nt, Artificial Sequence
  CXCR4 targeting guide RNA
agacuuaguggaaacagauga

SEQ ID NO: 195 - RNA, 21 nt, Artificial Sequence
  CXCR4 targeting guide RNA
aucuguuuccacuaagucuga

SEQ ID NO: 196 - RNA, 21 nt, Artificial Sequence
  CXCR4 targeting guide RNA
auucaucuguuuccacuaagu

SEQ ID NO: 197 - RNA, 21 nt, Artificial Sequence
  CXCR4 targeting guide RNA
cacuaagucugagucuucaag

SEQ ID NO: 198 - RNA, 21 nt, Artificial Sequence
  CXCR4 targeting guide RNA
cagacuuaguggaaacagaug

SEQ ID NO: 199 - RNA, 21 nt, Artificial Sequence
  CXCR4 targeting guide RNA
caucuguuuccacuaagucug

SEQ ID NO: 200 - RNA, 21 nt, Artificial Sequence
  CXCR4 targeting guide RNA
cauucaucuguuuccacuaag

SEQ ID NO: 201 - RNA, 21 nt, Artificial Sequence
  CXCR4 targeting guide RNA
ccacuaagucugagucuucaa

SEQ ID NO: 202 - RNA, 21 nt, Artificial Sequence
  CXCR4 targeting guide RNA
cuaagucugagucuucaaguu

SEQ ID NO: 203 - RNA, 21 nt, Artificial Sequence
  CXCR4 targeting guide RNA
cucagacuuaguggaaacaga

SEQ ID NO: 204 - RNA, 21 nt, Artificial Sequence
  CXCR4 targeting guide RNA
cuguuuccacuaagucugagu

SEQ ID NO: 205 - RNA, 21 nt, Artificial Sequence
  CXCR4 targeting guide RNA
cuuaguggaaacagaugaaug

SEQ ID NO: 206 - RNA, 21 nt, Artificial Sequence
  CXCR4 targeting guide RNA
cuugaagacucagacuuagug

SEQ ID NO: 207 - RNA, 21 nt, Artificial Sequence
  CXCR4 targeting guide RNA
gaagacucagacuuaguggaa

SEQ ID NO: 208 - RNA, 21 nt, Artificial Sequence
  CXCR4 targeting guide RNA
gacauucaucuguuuccacua

SEQ ID NO: 209 - RNA, 21 nt, Artificial Sequence
  CXCR4 targeting guide RNA
gacucagacuuaguggaaaca

SEQ ID NO: 210 - RNA, 21 nt, Artificial Sequence
  CXCR4 targeting guide RNA
gacuuaguggaaacagaugaa

SEQ ID NO: 211 - RNA, 21 nt, Artificial Sequence
  CXCR4 targeting guide RNA
guuuccacuaagucugagucu

SEQ ID NO: 212 - RNA, 21 nt, Artificial Sequence
  CXCR4 targeting guide RNA
uaagucugagucuucaaguuu

SEQ ID NO: 213 - RNA, 21 nt, Artificial Sequence
  CXCR4 targeting guide RNA
uaguggaaacagaugaauguc

SEQ ID NO: 214 - RNA, 21 nt, Artificial Sequence
  CXCR4 targeting guide RNA
ucagacuuaguggaaacagau

SEQ ID NO: 215 - RNA, 21 nt, Artificial Sequence
  CXCR4 targeting guide RNA
ucaucuguuuccacuaagucu

SEQ ID NO: 216 - RNA, 21 nt, Artificial Sequence
  CXCR4 targeting guide RNA
uccacuaagucugagucuuca

SEQ ID NO: 217 - RNA, 21 nt, Artificial Sequence
  CXCR4 targeting guide RNA
ucuguuuccacuaagucugag

SEQ ID NO: 218 - RNA, 21 nt, Artificial Sequence
  CXCR4 targeting guide RNA
ugaagacucagacuuagugga

SEQ ID NO: 219 - RNA, 21 nt, Artificial Sequence
  CXCR4 targeting guide RNA
uguuuccacuaagucugaguc

SEQ ID NO: 220 - RNA, 21 nt, Artificial Sequence
  CXCR4 targeting guide RNA
uuaguggaaacagaugaaugu

SEQ ID NO: 221 - RNA, 21 nt, Artificial Sequence
  CXCR4 targeting guide RNA
uucaucuguuuccacuaaguc

SEQ ID NO: 222 - RNA, 21 nt, Artificial Sequence
  CXCR4 targeting guide RNA
uuccacuaagucugagucuuc

SEQ ID NO: 223 - RNA, 21 nt, Artificial Sequence
  CXCR4 targeting guide RNA
uugaagacucagacuuagugg

SEQ ID NO: 224 - RNA, 21 nt, Artificial Sequence
  CXCR4 targeting guide RNA
uuuccacuaagucugagucuu

SEQ ID NO: 225 - RNA, 22 nt, Artificial Sequence
  CXCR4 targeting guide RNA
aaaacuugaagacucagacuua

SEQ ID NO: 226 - RNA, 22 nt, Artificial Sequence
  CXCR4 targeting guide RNA
aaacuugaagacucagacuuag

SEQ ID NO: 227 - RNA, 22 nt, Artificial Sequence
  CXCR4 targeting guide RNA
aacuugaagacucagacuuagu

SEQ ID NO: 228 - RNA, 22 nt, Artificial Sequence
  CXCR4 targeting guide RNA
aagacucagacuuaguggaaac

SEQ ID NO: 229 - RNA, 22 nt, Artificial Sequence
  CXCR4 targeting guide RNA
acauucaucuguuuccacuaag

SEQ ID NO: 230 - RNA, 22 nt, Artificial Sequence
  CXCR4 targeting guide RNA
acuaagucugagucuucaaguu

SEQ ID NO: 231 - RNA, 22 nt, Artificial Sequence
  CXCR4 targeting guide RNA
acucagacuuaguggaaacaga

SEQ ID NO: 232 - RNA, 22 nt, Artificial Sequence
  CXCR4 targeting guide RNA
acuuaguggaaacagaugaaug

SEQ ID NO: 233 - RNA, 22 nt, Artificial Sequence
  CXCR4 targeting guide RNA
acuugaagacucagacuuagug

SEQ ID NO: 234 - RNA, 22 nt, Artificial Sequence
  CXCR4 targeting guide RNA
agacucagacuuaguggaaaca

SEQ ID NO: 235 - RNA, 22 nt, Artificial Sequence
  CXCR4 targeting guide RNA
agacuuaguggaaacagaugaa

SEQ ID NO: 236 - RNA, 22 nt, Artificial Sequence
  CXCR4 targeting guide RNA
aucuguuuccacuaagucugag

SEQ ID NO: 237 - RNA, 22 nt, Artificial Sequence
  CXCR4 targeting guide RNA
auucaucuguuuccacuaaguc

SEQ ID NO: 238 - RNA, 22 nt, Artificial Sequence
  CXCR4 targeting guide RNA
cacuaagucugagucuucaagu

SEQ ID NO: 239 - RNA, 22 nt, Artificial Sequence
  CXCR4 targeting guide RNA
cagacuuaguggaaacagauga

SEQ ID NO: 240 - RNA, 22 nt, Artificial Sequence
  CXCR4 targeting guide RNA
caucuguuuccacuaagucuga

SEQ ID NO: 241 - RNA, 22 nt, Artificial Sequence
  CXCR4 targeting guide RNA
cauucaucuguuuccacuaagu

SEQ ID NO: 242 - RNA, 22 nt, Artificial Sequence
  CXCR4 targeting guide RNA
ccacuaagucugagucuucaag

SEQ ID NO: 243 - RNA, 22 nt, Artificial Sequence
  CXCR4 targeting guide RNA
cuaagucugagucuucaaguuu

SEQ ID NO: 244 - RNA, 22 nt, Artificial Sequence
  CXCR4 targeting guide RNA
cucagacuuaguggaaacagau

SEQ ID NO: 245 - RNA, 22 nt, Artificial Sequence
  CXCR4 targeting guide RNA
cuguuuccacuaagucugaguc

SEQ ID NO: 246 - RNA, 22 nt, Artificial Sequence
  CXCR4 targeting guide RNA
cuuaguggaaacagaugaaugu

SEQ ID NO: 247 - RNA, 22 nt, Artificial Sequence
  CXCR4 targeting guide RNA
cuugaagacucagacuuagugg

SEQ ID NO: 248 - RNA, 22 nt, Artificial Sequence
  CXCR4 targeting guide RNA
gaaaacuugaagacucagacuu

SEQ ID NO: 249 - RNA, 22 nt, Artificial Sequence
  CXCR4 targeting guide RNA
gaagacucagacuuaguggaaa

SEQ ID NO: 250 - RNA, 22 nt, Artificial Sequence
  CXCR4 targeting guide RNA
gacauucaucuguuuccacuaa

SEQ ID NO: 251 - RNA, 22 nt, Artificial Sequence
  CXCR4 targeting guide RNA
gacucagacuuaguggaaacag

SEQ ID NO: 252 - RNA, 22 nt, Artificial Sequence
  CXCR4 targeting guide RNA
gacuuaguggaaacagaugaau

SEQ ID NO: 253 - RNA, 22 nt, Artificial Sequence
  CXCR4 targeting guide RNA
ggacauucaucuguuuccacua

SEQ ID NO: 254 - RNA, 22 nt, Artificial Sequence
  CXCR4 targeting guide RNA
guuuccacuaagucugagucuu

SEQ ID NO: 255 - RNA, 22 nt, Artificial Sequence
  CXCR4 targeting guide RNA
uaagucugagucuucaaguuuu

SEQ ID NO: 256 - RNA, 22 nt, Artificial Sequence
  CXCR4 targeting guide RNA
uaguggaaacagaugaaugucc

SEQ ID NO: 257 - RNA, 22 nt, Artificial Sequence
  CXCR4 targeting guide RNA
ucagacuuaguggaaacagaug

SEQ ID NO: 258 - RNA, 22 nt, Artificial Sequence
  CXCR4 targeting guide RNA
ucaucuguuuccacuaagucug

SEQ ID NO: 259 - RNA, 22 nt, Artificial Sequence
  CXCR4 targeting guide RNA
uccacuaagucugagucuucaa

SEQ ID NO: 260 - RNA, 22 nt, Artificial Sequence
  CXCR4 targeting guide RNA
ucuguuuccacuaagucugagu

SEQ ID NO: 261 - RNA, 22 nt, Artificial Sequence
  CXCR4 targeting guide RNA
ugaagacucagacuuaguggaa

SEQ ID NO: 262 - RNA, 22 nt, Artificial Sequence
  CXCR4 targeting guide RNA
uguuuccacuaagucugagucu

SEQ ID NO: 263 - RNA, 22 nt, Artificial Sequence
  CXCR4 targeting guide RNA
uuaguggaaacagaugaauguc

SEQ ID NO: 264 - RNA, 22 nt, Artificial Sequence
  CXCR4 targeting guide RNA
uucaucuguuuccacuaagucu

SEQ ID NO: 265 - RNA, 22 nt, Artificial Sequence
  CXCR4 targeting guide RNA
uuccacuaagucugagucuuca

SEQ ID NO: 266 - RNA, 22 nt, Artificial Sequence
  CXCR4 targeting guide RNA
uugaagacucagacuuagugga

SEQ ID NO: 267 - RNA, 22 nt, Artificial Sequence
  CXCR4 targeting guide RNA
uuuccacuaagucugagucuuc

SEQ ID NO: 268 - RNA, 20 nt, Artificial Sequence
  CXCR4 targeting guide RNA
aaacaugaauguccaccucg

SEQ ID NO: 269 - RNA, 20 nt, Artificial Sequence
  CXCR4 targeting guide RNA
aaagcgagguggacauucau

SEQ ID NO: 270 - RNA, 20 nt, Artificial Sequence
  CXCR4 targeting guide RNA
aacaugaauguccaccucgc

SEQ ID NO: 271 - RNA, 20 nt, Artificial Sequence
  CXCR4 targeting guide RNA
aagacucagacucaguggaa

SEQ ID NO: 272 - RNA, 20 nt, Artificial Sequence
  CXCR4 targeting guide RNA
aagcgagguggacauucaug

SEQ ID NO: 273 - RNA, 20 nt, Artificial Sequence
  CXCR4 targeting guide RNA
acaugaauguccaccucgcu

SEQ ID NO: 274 - RNA, 20 nt, Artificial Sequence
  CXCR4 targeting guide RNA
acauucauguuuccacugag

SEQ ID NO: 275 - RNA, 20 nt, Artificial Sequence
  CXCR4 targeting guide RNA
acucagacucaguggaaaca

SEQ ID NO: 276 - RNA, 20 nt, Artificial Sequence
  CXCR4 targeting guide RNA
acucaguggaaacaugaaug

SEQ ID NO: 277 - RNA, 20 nt, Artificial Sequence
  CXCR4 targeting guide RNA
agacucagacucaguggaaa

SEQ ID NO: 278 - RNA, 20 nt, Artificial Sequence
  CXCR4 targeting guide RNA
agacucaguggaaacaugaa

SEQ ID NO: 279 - RNA, 20 nt, Artificial Sequence
  CXCR4 targeting guide RNA
agcgagguggacauucaugu

SEQ ID NO: 280 - RNA, 20 nt, Artificial Sequence
  CXCR4 targeting guide RNA
aggaaagcgagguggacauu

SEQ ID NO: 281 - RNA, 20 nt, Artificial Sequence
  CXCR4 targeting guide RNA
agguggacauucauguuucc

SEQ ID NO: 282 - RNA, 20 nt, Artificial Sequence
  CXCR4 targeting guide RNA
aguggaaacaugaaugucca

SEQ ID NO: 283 - RNA, 20 nt, Artificial Sequence
  CXCR4 targeting guide RNA
auguuuccacugagucugag

SEQ ID NO: 284 - RNA, 20 nt, Artificial Sequence
  CXCR4 targeting guide RNA
auucauguuuccacugaguc

SEQ ID NO: 285 - RNA, 20 nt, Artificial Sequence
  CXCR4 targeting guide RNA
cagacucaguggaaacauga

SEQ ID NO: 286 - RNA, 20 nt, Artificial Sequence
  CXCR4 targeting guide RNA
caguggaaacaugaaugucc

SEQ ID NO: 287 - RNA, 20 nt, Artificial Sequence
  CXCR4 targeting guide RNA
caugaauguccaccucgcuu

SEQ ID NO: 288 - RNA, 20 nt, Artificial Sequence
  CXCR4 targeting guide RNA
cauguuuccacugagucuga

SEQ ID NO: 289 - RNA, 20 nt, Artificial Sequence
  CXCR4 targeting guide RNA
cauucauguuuccacugagu

SEQ ID NO: 290 - RNA, 20 nt, Artificial Sequence
  CXCR4 targeting guide RNA
cgagguggacauucauguuu

SEQ ID NO: 291 - RNA, 20 nt, Artificial Sequence
  CXCR4 targeting guide RNA
cucagacucaguggaaacau

SEQ ID NO: 292 - RNA, 20 nt, Artificial Sequence
  CXCR4 targeting guide RNA
cucaguggaaacaugaaugu

SEQ ID NO: 293 - RNA, 20 nt, Artificial Sequence
  CXCR4 targeting guide RNA
gaaacaugaauguccaccuc

SEQ ID NO: 294 - RNA, 20 nt, Artificial Sequence
  CXCR4 targeting guide RNA
gaaagcgagguggacauuca

SEQ ID NO: 295 - RNA, 20 nt, Artificial Sequence
  CXCR4 targeting guide RNA
gaagacucagacucagugga

SEQ ID NO: 296 - RNA, 20 nt, Artificial Sequence
  CXCR4 targeting guide RNA
gacauucauguuuccacuga

SEQ ID NO: 297 - RNA, 20 nt, Artificial Sequence
  CXCR4 targeting guide RNA
gacucagacucaguggaaac

SEQ ID NO: 298 - RNA, 20 nt, Artificial Sequence
  CXCR4 targeting guide RNA
gacucaguggaaacaugaau

SEQ ID NO: 299 - RNA, 20 nt, Artificial Sequence
  CXCR4 targeting guide RNA
gagguggacauucauguuuc

SEQ ID NO: 300 - RNA, 20 nt, Artificial Sequence
  CXCR4 targeting guide RNA
gcgagguggacauucauguu

SEQ ID NO: 301 - RNA, 20 nt, Artificial Sequence
  CXCR4 targeting guide RNA
ggaaacaugaauguccaccu

SEQ ID NO: 302 - RNA, 20 nt, Artificial Sequence
  CXCR4 targeting guide RNA
ggaaagcgagguggacauuc

SEQ ID NO: 303 - RNA, 20 nt, Artificial Sequence
  CXCR4 targeting guide RNA
ggacauucauguuuccacug

SEQ ID NO: 304 - RNA, 20 nt, Artificial Sequence
  CXCR4 targeting guide RNA
gguggacauucauguuucca

SEQ ID NO: 305 - RNA, 20 nt, Artificial Sequence
  CXCR4 targeting guide RNA
guggaaacaugaauguccac

SEQ ID NO: 306 - RNA, 20 nt, Artificial Sequence
  CXCR4 targeting guide RNA
guggacauucauguuuccac

SEQ ID NO: 307 - RNA, 20 nt, Artificial Sequence
  CXCR4 targeting guide RNA
ucagacucaguggaaacaug

SEQ ID NO: 308 - RNA, 20 nt, Artificial Sequence
  CXCR4 targeting guide RNA
ucaguggaaacaugaauguc

SEQ ID NO: 309 - RNA, 20 nt, Artificial Sequence
  CXCR4 targeting guide RNA
ucauguuuccacugagucug

SEQ ID NO: 310 - RNA, 20 nt, Artificial Sequence
  CXCR4 targeting guide RNA
uggaaacaugaauguccacc

SEQ ID NO: 311 - RNA, 20 nt, Artificial Sequence
  CXCR4 targeting guide RNA
uggacauucauguuuccacu

SEQ ID NO: 312 - RNA, 20 nt, Artificial Sequence
  CXCR4 targeting guide RNA
uguuuccacugagucugagu

SEQ ID NO: 313 - RNA, 20 nt, Artificial Sequence
  CXCR4 targeting guide RNA
uucauguuuccacugagucu

SEQ ID NO: 314 - RNA, 21 nt, Artificial Sequence
  CXCR4 targeting guide RNA
aaacaugaauguccaccucgc

SEQ ID NO: 315 - RNA, 21 nt, Artificial Sequence
  CXCR4 targeting guide RNA
aaagcgagguggacauucaug

SEQ ID NO: 316 - RNA, 21 nt, Artificial Sequence
  CXCR4 targeting guide RNA
aacaugaauguccaccucgcu

SEQ ID NO: 317 - RNA, 21 nt, Artificial Sequence
  CXCR4 targeting guide RNA
aagacucagacucaguggaaa

SEQ ID NO: 318 - RNA, 21 nt, Artificial Sequence
  CXCR4 targeting guide RNA
aagcgagguggacauucaugu

SEQ ID NO: 319 - RNA, 21 nt, Artificial Sequence
  CXCR4 targeting guide RNA
aaggaaagcgagguggacauu

SEQ ID NO: 320 - RNA, 21 nt, Artificial Sequence
  CXCR4 targeting guide RNA
acaugaauguccaccucgcuu

SEQ ID NO: 321 - RNA, 21 nt, Artificial Sequence
  CXCR4 targeting guide RNA
acauucauguuuccacugagu

SEQ ID NO: 322 - RNA, 21 nt, Artificial Sequence
  CXCR4 targeting guide RNA
acucagacucaguggaaacau

SEQ ID NO: 323 - RNA, 21 nt, Artificial Sequence
  CXCR4 targeting guide RNA
acucaguggaaacaugaaugu

SEQ ID NO: 324 - RNA, 21 nt, Artificial Sequence
  CXCR4 targeting guide RNA
agacucagacucaguggaaac

SEQ ID NO: 325 - RNA, 21 nt, Artificial Sequence
  CXCR4 targeting guide RNA
agacucaguggaaacaugaau

SEQ ID NO: 326 - RNA, 21 nt, Artificial Sequence
  CXCR4 targeting guide RNA
agcgagguggacauucauguu

SEQ ID NO: 327 - RNA, 21 nt, Artificial Sequence
  CXCR4 targeting guide RNA
aggaaagcgagguggacauuc

SEQ ID NO: 328 - RNA, 21 nt, Artificial Sequence
  CXCR4 targeting guide RNA
agguggacauucauguuucca

SEQ ID NO: 329 - RNA, 21 nt, Artificial Sequence
  CXCR4 targeting guide RNA
aguggaaacaugaauguccac

SEQ ID NO: 330 - RNA, 21 nt, Artificial Sequence
  CXCR4 targeting guide RNA
auguuuccacugagucugagu

SEQ ID NO: 331 - RNA, 21 nt, Artificial Sequence
  CXCR4 targeting guide RNA
auucauguuuccacugagucu

SEQ ID NO: 332 - RNA, 21 nt, Artificial Sequence
  CXCR4 targeting guide RNA
cagacucaguggaaacaugaa

SEQ ID NO: 333 - RNA, 21 nt, Artificial Sequence
  CXCR4 targeting guide RNA
caguggaaacaugaaugucca

SEQ ID NO: 334 - RNA, 21 nt, Artificial Sequence
  CXCR4 targeting guide RNA
caugaauguccaccucgcuuu

SEQ ID NO: 335 - RNA, 21 nt, Artificial Sequence
  CXCR4 targeting guide RNA
cauguuuccacugagucugag

SEQ ID NO: 336 - RNA, 21 nt, Artificial Sequence
  CXCR4 targeting guide RNA
cauucauguuuccacugaguc

SEQ ID NO: 337 - RNA, 21 nt, Artificial Sequence
  CXCR4 targeting guide RNA
cgagguggacauucauguuuc

SEQ ID NO: 338 - RNA, 21 nt, Artificial Sequence
  CXCR4 targeting guide RNA
cucagacucaguggaaacaug

SEQ ID NO: 339 - RNA, 21 nt, Artificial Sequence
  CXCR4 targeting guide RNA
cucaguggaaacaugaauguc

SEQ ID NO: 340 - RNA, 21 nt, Artificial Sequence
  CXCR4 targeting guide RNA
gaaacaugaauguccaccucg

SEQ ID NO: 341 - RNA, 21 nt, Artificial Sequence
  CXCR4 targeting guide RNA
gaaagcgagguggacauucau

SEQ ID NO: 342 - RNA, 21 nt, Artificial Sequence
  CXCR4 targeting guide RNA
gaagacucagacucaguggaa

SEQ ID NO: 343 - RNA, 21 nt, Artificial Sequence
  CXCR4 targeting guide RNA
gacauucauguuuccacugag

SEQ ID NO: 344 - RNA, 21 nt, Artificial Sequence
  CXCR4 targeting guide RNA
gacucagacucaguggaaaca

SEQ ID NO: 345 - RNA, 21 nt, Artificial Sequence
  CXCR4 targeting guide RNA
gacucaguggaaacaugaaug

SEQ ID NO: 346 - RNA, 21 nt, Artificial Sequence
  CXCR4 targeting guide RNA
gagguggacauucauguuucc

SEQ ID NO: 347 - RNA, 21 nt, Artificial Sequence
  CXCR4 targeting guide RNA
gcgagguggacauucauguuu

SEQ ID NO: 348 - RNA, 21 nt, Artificial Sequence
  CXCR4 targeting guide RNA
ggaaacaugaauguccaccuc

SEQ ID NO: 349 - RNA, 21 nt, Artificial Sequence
  CXCR4 targeting guide RNA
ggaaagcgagguggacauuca

SEQ ID NO: 350 - RNA, 21 nt, Artificial Sequence
  CXCR4 targeting guide RNA
ggacauucauguuuccacuga

SEQ ID NO: 351 - RNA, 21 nt, Artificial Sequence
  CXCR4 targeting guide RNA
gguggacauucauguuuccac

SEQ ID NO: 352 - RNA, 21 nt, Artificial Sequence
  CXCR4 targeting guide RNA
guggaaacaugaauguccacc

SEQ ID NO: 353 - RNA, 21 nt, Artificial Sequence
  CXCR4 targeting guide RNA
guggacauucauguuuccacu

SEQ ID NO: 354 - RNA, 21 nt, Artificial Sequence
  CXCR4 targeting guide RNA
ucagacucaguggaaacauga

SEQ ID NO: 355 - RNA, 21 nt, Artificial Sequence
  CXCR4 targeting guide RNA
ucaguggaaacaugaaugucc

SEQ ID NO: 356 - RNA, 21 nt, Artificial Sequence
  CXCR4 targeting guide RNA
ucauguuuccacugagucuga

SEQ ID NO: 357 - RNA, 21 nt, Artificial Sequence
  CXCR4 targeting guide RNA
ugaagacucagacucagugga

SEQ ID NO: 358 - RNA, 21 nt, Artificial Sequence
  CXCR4 targeting guide RNA
uggaaacaugaauguccaccu

SEQ ID NO: 359 - RNA, 21 nt, Artificial Sequence
  CXCR4 targeting guide RNA
uggacauucauguuuccacug

SEQ ID NO: 360 - RNA, 21 nt, Artificial Sequence
  CXCR4 targeting guide RNA
uguuuccacugagucugaguc

SEQ ID NO: 361 - RNA, 21 nt, Artificial Sequence
  CXCR4 targeting guide RNA
uucauguuuccacugagucug

SEQ ID NO: 362 - RNA, 22 nt, Artificial Sequence
  CXCR4 targeting guide RNA
aaacaugaauguccaccucgcu

SEQ ID NO: 363 - RNA, 22 nt, Artificial Sequence
  CXCR4 targeting guide RNA
aaagcgagguggacauucaugu

SEQ ID NO: 364 - RNA, 22 nt, Artificial Sequence
  CXCR4 targeting guide RNA
aaaggaaagcgagguggacauu

SEQ ID NO: 365 - RNA, 22 nt, Artificial Sequence
  CXCR4 targeting guide RNA
aacaugaauguccaccucgcuu

SEQ ID NO: 366 - RNA, 22 nt, Artificial Sequence
  CXCR4 targeting guide RNA
aagacucagacucaguggaaac

SEQ ID NO: 367 - RNA, 22 nt, Artificial Sequence
  CXCR4 targeting guide RNA
aagcgagguggacauucauguu

SEQ ID NO: 368 - RNA, 22 nt, Artificial Sequence
  CXCR4 targeting guide RNA
aaggaaagcgagguggacauuc

SEQ ID NO: 369 - RNA, 22 nt, Artificial Sequence
  CXCR4 targeting guide RNA
acaugaauguccaccucgcuuu

SEQ ID NO: 370 - RNA, 22 nt, Artificial Sequence
  CXCR4 targeting guide RNA
acauucauguuuccacugaguc

SEQ ID NO: 371 - RNA, 22 nt, Artificial Sequence
  CXCR4 targeting guide RNA
acucagacucaguggaaacaug

SEQ ID NO: 372 - RNA, 22 nt, Artificial Sequence
  CXCR4 targeting guide RNA
acucaguggaaacaugaauguc

SEQ ID NO: 373 - RNA, 22 nt, Artificial Sequence
  CXCR4 targeting guide RNA
agacucagacucaguggaaaca

SEQ ID NO: 374 - RNA, 22 nt, Artificial Sequence
  CXCR4 targeting guide RNA
agacucaguggaaacaugaaug

SEQ ID NO: 375 - RNA, 22 nt, Artificial Sequence
  CXCR4 targeting guide RNA
agcgagguggacauucauguuu

SEQ ID NO: 376 - RNA, 22 nt, Artificial Sequence
  CXCR4 targeting guide RNA
aggaaagcgagguggacauuca

SEQ ID NO: 377 - RNA, 22 nt, Artificial Sequence
  CXCR4 targeting guide RNA
agguggacauucauguuuccac

SEQ ID NO: 378 - RNA, 22 nt, Artificial Sequence
  CXCR4 targeting guide RNA
aguggaaacaugaauguccacc

SEQ ID NO: 379 - RNA, 22 nt, Artificial Sequence
  CXCR4 targeting guide RNA
auguuuccacugagucugaguc

SEQ ID NO: 380 - RNA, 22 nt, Artificial Sequence
  CXCR4 targeting guide RNA
auucauguuuccacugagucug

SEQ ID NO: 381 - RNA, 22 nt, Artificial Sequence
  CXCR4 targeting guide RNA
cagacucaguggaaacaugaau

SEQ ID NO: 382 - RNA, 22 nt, Artificial Sequence
  CXCR4 targeting guide RNA
caguggaaacaugaauguccac

SEQ ID NO: 383 - RNA, 22 nt, Artificial Sequence
  CXCR4 targeting guide RNA
caugaauguccaccucgcuuuc

SEQ ID NO: 384 - RNA, 22 nt, Artificial Sequence
  CXCR4 targeting guide RNA
cauguuuccacugagucugagu

SEQ ID NO: 385 - RNA, 22 nt, Artificial Sequence
  CXCR4 targeting guide RNA
cauucauguuuccacugagucu

SEQ ID NO: 386 - RNA, 22 nt, Artificial Sequence
  CXCR4 targeting guide RNA
cgagguggacauucauguuucc

SEQ ID NO: 387 - RNA, 22 nt, Artificial Sequence
  CXCR4 targeting guide RNA
cucagacucaguggaaacauga

SEQ ID NO: 388 - RNA, 22 nt, Artificial Sequence
  CXCR4 targeting guide RNA
cucaguggaaacaugaaugucc

SEQ ID NO: 389 - RNA, 22 nt, Artificial Sequence
  CXCR4 targeting guide RNA
gaaacaugaauguccaccucgc

SEQ ID NO: 390 - RNA, 22 nt, Artificial Sequence
  CXCR4 targeting guide RNA
gaaagcgagguggacauucaug

SEQ ID NO: 391 - RNA, 22 nt, Artificial Sequence
  CXCR4 targeting guide RNA
gaagacucagacucaguggaaa

SEQ ID NO: 392 - RNA, 22 nt, Artificial Sequence
  CXCR4 targeting guide RNA
gacauucauguuuccacugagu

SEQ ID NO: 393 - RNA, 22 nt, Artificial Sequence
  CXCR4 targeting guide RNA
gacucagacucaguggaaacau

SEQ ID NO: 394 - RNA, 22 nt, Artificial Sequence
  CXCR4 targeting guide RNA
gacucaguggaaacaugaaugu

SEQ ID NO: 395 - RNA, 22 nt, Artificial Sequence
  CXCR4 targeting guide RNA
gagguggacauucauguuucca

SEQ ID NO: 396 - RNA, 22 nt, Artificial Sequence
  CXCR4 targeting guide RNA
gcgagguggacauucauguuuc

SEQ ID NO: 397 - RNA, 22 nt, Artificial Sequence
  CXCR4 targeting guide RNA
ggaaacaugaauguccaccucg

SEQ ID NO: 398 - RNA, 22 nt, Artificial Sequence
  CXCR4 targeting guide RNA
ggaaagcgagguggacauucau

SEQ ID NO: 399 - RNA, 22 nt, Artificial Sequence
  CXCR4 targeting guide RNA
ggacauucauguuuccacugag

SEQ ID NO: 400 - RNA, 22 nt, Artificial Sequence
  CXCR4 targeting guide RNA
gguggacauucauguuuccacu

SEQ ID NO: 401 - RNA, 22 nt, Artificial Sequence
  CXCR4 targeting guide RNA
guggaaacaugaauguccaccu

SEQ ID NO: 402 - RNA, 22 nt, Artificial Sequence
  CXCR4 targeting guide RNA
guggacauucauguuuccacug

SEQ ID NO: 403 - RNA, 22 nt, Artificial Sequence
  CXCR4 targeting guide RNA
ucagacucaguggaaacaugaa

SEQ ID NO: 404 - RNA, 22 nt, Artificial Sequence
  CXCR4 targeting guide RNA
ucaguggaaacaugaaugucca

SEQ ID NO: 405 - RNA, 22 nt, Artificial Sequence
  CXCR4 targeting guide RNA
ucauguuuccacugagucugag

SEQ ID NO: 406 - RNA, 22 nt, Artificial Sequence
  CXCR4 targeting guide RNA
ugaagacucagacucaguggaa

SEQ ID NO: 407 - RNA, 22 nt, Artificial Sequence
  CXCR4 targeting guide RNA
uggaaacaugaauguccaccuc

SEQ ID NO: 408 - RNA, 22 nt, Artificial Sequence
  CXCR4 targeting guide RNA
uggacauucauguuuccacuga

SEQ ID NO: 409 - RNA, 22 nt, Artificial Sequence
  CXCR4 targeting guide RNA
uguuuccacugagucugagucu

SEQ ID NO: 410 - RNA, 22 nt, Artificial Sequence
  CXCR4 targeting guide RNA
uucauguuuccacugagucuga

SEQ ID NO: 411 - RNA, 22 nt, Artificial Sequence
  CXCR4 targeting guide RNA
uugaagacucagacucagugga

SEQ ID NO: 412 - RNA, 20 nt, Artificial Sequence
  CXCR4 targeting guide RNA
aaacagaucaauguccaccu

SEQ ID NO: 413 - RNA, 20 nt, Artificial Sequence
  CXCR4 targeting guide RNA
aaagcgagguggacauugau

SEQ ID NO: 414 - RNA, 20 nt, Artificial Sequence
  CXCR4 targeting guide RNA
aaaggaaagcgagguggaca

SEQ ID NO: 415 - RNA, 20 nt, Artificial Sequence
  CXCR4 targeting guide RNA
aacagaucaauguccaccuc

SEQ ID NO: 416 - RNA, 20 nt, Artificial Sequence
  CXCR4 targeting guide RNA
aagcgagguggacauugauc

SEQ ID NO: 417 - RNA, 20 nt, Artificial Sequence
  CXCR4 targeting guide RNA
aaggaaagcgagguggacau

SEQ ID NO: 418 - RNA, 20 nt, Artificial Sequence
  CXCR4 targeting guide RNA
acagaucaauguccaccucg

SEQ ID NO: 419 - RNA, 20 nt, Artificial Sequence
  CXCR4 targeting guide RNA
acauugaucuguuuccacug

SEQ ID NO: 420 - RNA, 20 nt, Artificial Sequence
  CXCR4 targeting guide RNA
acucaguggaaacagaucaa

SEQ ID NO: 421 - RNA, 20 nt, Artificial Sequence
  CXCR4 targeting guide RNA
agacucaguggaaacagauc

SEQ ID NO: 422 - RNA, 20 nt, Artificial Sequence
  CXCR4 targeting guide RNA
agaucaauguccaccucgcu

SEQ ID NO: 423 - RNA, 20 nt, Artificial Sequence
  CXCR4 targeting guide RNA
agcgagguggacauugaucu

SEQ ID NO: 424 - RNA, 20 nt, Artificial Sequence
  CXCR4 targeting guide RNA
agguggacauugaucuguuu

SEQ ID NO: 425 - RNA, 20 nt, Artificial Sequence
  CXCR4 targeting guide RNA
aguggaaacagaucaauguc

SEQ ID NO: 426 - RNA, 20 nt, Artificial Sequence
  CXCR4 targeting guide RNA
aucaauguccaccucgcuuu

SEQ ID NO: 427 - RNA, 20 nt, Artificial Sequence
  CXCR4 targeting guide RNA
auugaucuguuuccacugag

SEQ ID NO: 428 - RNA, 20 nt, Artificial Sequence
  CXCR4 targeting guide RNA
caaaggaaagcgagguggac

SEQ ID NO: 429 - RNA, 20 nt, Artificial Sequence
  CXCR4 targeting guide RNA
caauguccaccucgcuuucc

SEQ ID NO: 430 - RNA, 20 nt, Artificial Sequence
  CXCR4 targeting guide RNA
cagacucaguggaaacagau

SEQ ID NO: 431 - RNA, 20 nt, Artificial Sequence
  CXCR4 targeting guide RNA
cagaucaauguccaccucgc

SEQ ID NO: 432 - RNA, 20 nt, Artificial Sequence
  CXCR4 targeting guide RNA
caguggaaacagaucaaugu

SEQ ID NO: 433 - RNA, 20 nt, Artificial Sequence
  CXCR4 targeting guide RNA
cauugaucuguuuccacuga

SEQ ID NO: 434 - RNA, 20 nt, Artificial Sequence
  CXCR4 targeting guide RNA
cgagguggacauugaucugu

SEQ ID NO: 435 - RNA, 20 nt, Artificial Sequence
  CXCR4 targeting guide RNA
cucagacucaguggaaacag

SEQ ID NO: 436 - RNA, 20 nt, Artificial Sequence
  CXCR4 targeting guide RNA
cucaguggaaacagaucaau

SEQ ID NO: 437 - RNA, 20 nt, Artificial Sequence
  CXCR4 targeting guide RNA
gaaacagaucaauguccacc

SEQ ID NO: 438 - RNA, 20 nt, Artificial Sequence
  CXCR4 targeting guide RNA
gaaagcgagguggacauuga

SEQ ID NO: 439 - RNA, 20 nt, Artificial Sequence
  CXCR4 targeting guide RNA
gacauugaucuguuuccacu

SEQ ID NO: 440 - RNA, 20 nt, Artificial Sequence
  CXCR4 targeting guide RNA
gacucaguggaaacagauca

SEQ ID NO: 441 - RNA, 20 nt, Artificial Sequence
  CXCR4 targeting guide RNA
gagguggacauugaucuguu

SEQ ID NO: 442 - RNA, 20 nt, Artificial Sequence
  CXCR4 targeting guide RNA
gaucaauguccaccucgcuu

SEQ ID NO: 443 - RNA, 20 nt, Artificial Sequence
  CXCR4 targeting guide RNA
gcgagguggacauugaucug

SEQ ID NO: 444 - RNA, 20 nt, Artificial Sequence
  CXCR4 targeting guide RNA
ggaaacagaucaauguccac

SEQ ID NO: 445 - RNA, 20 nt, Artificial Sequence
  CXCR4 targeting guide RNA
ggaaagcgagguggacauug

SEQ ID NO: 446 - RNA, 20 nt, Artificial Sequence
  CXCR4 targeting guide RNA
ggacauugaucuguuuccac

SEQ ID NO: 447 - RNA, 20 nt, Artificial Sequence
  CXCR4 targeting guide RNA
gguggacauugaucuguuuc

SEQ ID NO: 448 - RNA, 20 nt, Artificial Sequence
  CXCR4 targeting guide RNA
guggaaacagaucaaugucc

SEQ ID NO: 449 - RNA, 20 nt, Artificial Sequence
  CXCR4 targeting guide RNA
guggacauugaucuguuucc

SEQ ID NO: 450 - RNA, 20 nt, Artificial Sequence
  CXCR4 targeting guide RNA
ucaauguccaccucgcuuuc

SEQ ID NO: 451 - RNA, 20 nt, Artificial Sequence
  CXCR4 targeting guide RNA
ucagacucaguggaaacaga

SEQ ID NO: 452 - RNA, 20 nt, Artificial Sequence
  CXCR4 targeting guide RNA
ucaguggaaacagaucaaug

SEQ ID NO: 453 - RNA, 20 nt, Artificial Sequence
  CXCR4 targeting guide RNA
ugaucuguuuccacugaguc

SEQ ID NO: 454 - RNA, 20 nt, Artificial Sequence
  CXCR4 targeting guide RNA
uggaaacagaucaaugucca

SEQ ID NO: 455 - RNA, 20 nt, Artificial Sequence
  CXCR4 targeting guide RNA
uggacauugaucuguuucca

SEQ ID NO: 456 - RNA, 20 nt, Artificial Sequence
  CXCR4 targeting guide RNA
uugaucuguuuccacugagu

SEQ ID NO: 457 - RNA, 21 nt, Artificial Sequence
  CXCR4 targeting guide RNA
aaacagaucaauguccaccuc

SEQ ID NO: 458 - RNA, 21 nt, Artificial Sequence
  CXCR4 targeting guide RNA
aaagcgagguggacauugauc

SEQ ID NO: 459 - RNA, 21 nt, Artificial Sequence
  CXCR4 targeting guide RNA
aaaggaaagcgagguggacau

SEQ ID NO: 460 - RNA, 21 nt, Artificial Sequence
  CXCR4 targeting guide RNA
aacagaucaauguccaccucg

SEQ ID NO: 461 - RNA, 21 nt, Artificial Sequence
  CXCR4 targeting guide RNA
aagcgagguggacauugaucu

SEQ ID NO: 462 - RNA, 21 nt, Artificial Sequence
  CXCR4 targeting guide RNA
acagaucaauguccaccucgc

SEQ ID NO: 463 - RNA, 21 nt, Artificial Sequence
  CXCR4 targeting guide RNA
acauugaucuguuuccacuga

SEQ ID NO: 464 - RNA, 21 nt, Artificial Sequence
  CXCR4 targeting guide RNA
acucagacucaguggaaacag

SEQ ID NO: 465 - RNA, 21 nt, Artificial Sequence
  CXCR4 targeting guide RNA
acucaguggaaacagaucaau

SEQ ID NO: 466 - RNA, 21 nt, Artificial Sequence
  CXCR4 targeting guide RNA
agacucaguggaaacagauca

SEQ ID NO: 467 - RNA, 21 nt, Artificial Sequence
  CXCR4 targeting guide RNA
agaucaauguccaccucgcuu

SEQ ID NO: 468 - RNA, 21 nt, Artificial Sequence
  CXCR4 targeting guide RNA
agcgagguggacauugaucug

SEQ ID NO: 469 - RNA, 21 nt, Artificial Sequence
  CXCR4 targeting guide RNA
aggaaagcgagguggacauug

SEQ ID NO: 470 - RNA, 21 nt, Artificial Sequence
  CXCR4 targeting guide RNA
agguggacauugaucuguuuc

SEQ ID NO: 471 - RNA, 21 nt, Artificial Sequence
  CXCR4 targeting guide RNA
aguggaaacagaucaaugucc

SEQ ID NO: 472 - RNA, 21 nt, Artificial Sequence
  CXCR4 targeting guide RNA
aucaauguccaccucgcuuuc

SEQ ID NO: 473 - RNA, 21 nt, Artificial Sequence
  CXCR4 targeting guide RNA
auugaucuguuuccacugagu

SEQ ID NO: 474 - RNA, 21 nt, Artificial Sequence
  CXCR4 targeting guide RNA
caaaggaaagcgagguggaca

SEQ ID NO: 475 - RNA, 21 nt, Artificial Sequence
  CXCR4 targeting guide RNA
caauguccaccucgcuuuccu

SEQ ID NO: 476 - RNA, 21 nt, Artificial Sequence
  CXCR4 targeting guide RNA
cagacucaguggaaacagauc

SEQ ID NO: 477 - RNA, 21 nt, Artificial Sequence
  CXCR4 targeting guide RNA
cagaucaauguccaccucgcu

SEQ ID NO: 478 - RNA, 21 nt, Artificial Sequence
  CXCR4 targeting guide RNA
caguggaaacagaucaauguc

SEQ ID NO: 479 - RNA, 21 nt, Artificial Sequence
  CXCR4 targeting guide RNA
cauugaucuguuuccacugag

SEQ ID NO: 480 - RNA, 21 nt, Artificial Sequence
  CXCR4 targeting guide RNA
ccaaaggaaagcgagguggac

SEQ ID NO: 481 - RNA, 21 nt, Artificial Sequence
  CXCR4 targeting guide RNA
cgagguggacauugaucuguu

SEQ ID NO: 482 - RNA, 21 nt, Artificial Sequence
  CXCR4 targeting guide RNA
cucagacucaguggaaacaga

SEQ ID NO: 483 - RNA, 21 nt, Artificial Sequence
  CXCR4 targeting guide RNA
cucaguggaaacagaucaaug

SEQ ID NO: 484 - RNA, 21 nt, Artificial Sequence
  CXCR4 targeting guide RNA
gaaacagaucaauguccaccu

SEQ ID NO: 485 - RNA, 21 nt, Artificial Sequence
  CXCR4 targeting guide RNA
gaaagcgagguggacauugau

SEQ ID NO: 486 - RNA, 21 nt, Artificial Sequence
  CXCR4 targeting guide RNA
gacauugaucuguuuccacug

SEQ ID NO: 487 - RNA, 21 nt, Artificial Sequence
  CXCR4 targeting guide RNA
gacucaguggaaacagaucaa

SEQ ID NO: 488 - RNA, 21 nt, Artificial Sequence
  CXCR4 targeting guide RNA
gagguggacauugaucuguuu

SEQ ID NO: 489 - RNA, 21 nt, Artificial Sequence
  CXCR4 targeting guide RNA
gaucaauguccaccucgcuuu

SEQ ID NO: 490 - RNA, 21 nt, Artificial Sequence
  CXCR4 targeting guide RNA
gcgagguggacauugaucugu

SEQ ID NO: 491 - RNA, 21 nt, Artificial Sequence
  CXCR4 targeting guide RNA
ggaaacagaucaauguccacc

SEQ ID NO: 492 - RNA, 21 nt, Artificial Sequence
  CXCR4 targeting guide RNA
ggaaagcgagguggacauuga

SEQ ID NO: 493 - RNA, 21 nt, Artificial Sequence
  CXCR4 targeting guide RNA
ggacauugaucuguuuccacu

SEQ ID NO: 494 - RNA, 21 nt, Artificial Sequence
  CXCR4 targeting guide RNA
gguggacauugaucuguuucc

SEQ ID NO: 495 - RNA, 21 nt, Artificial Sequence
  CXCR4 targeting guide RNA
guggaaacagaucaaugucca

SEQ ID NO: 496 - RNA, 21 nt, Artificial Sequence
  CXCR4 targeting guide RNA
guggacauugaucuguuucca

SEQ ID NO: 497 - RNA, 21 nt, Artificial Sequence
  CXCR4 targeting guide RNA
ucaauguccaccucgcuuucc

SEQ ID NO: 498 - RNA, 21 nt, Artificial Sequence
  CXCR4 targeting guide RNA
ucagacucaguggaaacagau

SEQ ID NO: 499 - RNA, 21 nt, Artificial Sequence
  CXCR4 targeting guide RNA
ucaguggaaacagaucaaugu

SEQ ID NO: 500 - RNA, 21 nt, Artificial Sequence
  CXCR4 targeting guide RNA
ugaucuguuuccacugagucu

SEQ ID NO: 501 - RNA, 21 nt, Artificial Sequence
  CXCR4 targeting guide RNA
uggaaacagaucaauguccac

SEQ ID NO: 502 - RNA, 21 nt, Artificial Sequence
  CXCR4 targeting guide RNA
uggacauugaucuguuuccac

SEQ ID NO: 503 - RNA, 21 nt, Artificial Sequence
  CXCR4 targeting guide RNA
uugaucuguuuccacugaguc

SEQ ID NO: 504 - RNA, 22 nt, Artificial Sequence
  CXCR4 targeting guide RNA
aaacagaucaauguccaccucg

SEQ ID NO: 505 - RNA, 22 nt, Artificial Sequence
  CXCR4 targeting guide RNA
aaagcgagguggacauugaucu

SEQ ID NO: 506 - RNA, 22 nt, Artificial Sequence
  CXCR4 targeting guide RNA
aacagaucaauguccaccucgc

SEQ ID NO: 507 - RNA, 22 nt, Artificial Sequence
  CXCR4 targeting guide RNA
aagcgagguggacauugaucug

SEQ ID NO: 508 - RNA, 22 nt, Artificial Sequence
  CXCR4 targeting guide RNA
aaggaaagcgagguggacauug

SEQ ID NO: 509 - RNA, 22 nt, Artificial Sequence
  CXCR4 targeting guide RNA
acagaucaauguccaccucgcu

SEQ ID NO: 510 - RNA, 22 nt, Artificial Sequence
  CXCR4 targeting guide RNA
acauugaucuguuuccacugag

SEQ ID NO: 511 - RNA, 22 nt, Artificial Sequence
  CXCR4 targeting guide RNA
acucagacucaguggaaacaga

SEQ ID NO: 512 - RNA, 22 nt, Artificial Sequence
  CXCR4 targeting guide RNA
acucaguggaaacagaucaaug

SEQ ID NO: 513 - RNA, 22 nt, Artificial Sequence
  CXCR4 targeting guide RNA
agacucaguggaaacagaucaa

SEQ ID NO: 514 - RNA, 22 nt, Artificial Sequence
  CXCR4 targeting guide RNA
agaucaauguccaccucgcuuu

SEQ ID NO: 515 - RNA, 22 nt, Artificial Sequence
  CXCR4 targeting guide RNA
agcgagguggacauugaucugu

SEQ ID NO: 516 - RNA, 22 nt, Artificial Sequence
  CXCR4 targeting guide RNA
aggaaagcgagguggacauuga

SEQ ID NO: 517 - RNA, 22 nt, Artificial Sequence
  CXCR4 targeting guide RNA
agguggacauugaucuguuucc

SEQ ID NO: 518 - RNA, 22 nt, Artificial Sequence
  CXCR4 targeting guide RNA
aguggaaacagaucaaugucca

SEQ ID NO: 519 - RNA, 22 nt, Artificial Sequence
  CXCR4 targeting guide RNA
aucaauguccaccucgcuuucc

SEQ ID NO: 520 - RNA, 22 nt, Artificial Sequence
  CXCR4 targeting guide RNA
auugaucuguuuccacugaguc

SEQ ID NO: 521 - RNA, 22 nt, Artificial Sequence
  CXCR4 targeting guide RNA
caaaggaaagcgagguggacau

SEQ ID NO: 522 - RNA, 22 nt, Artificial Sequence
  CXCR4 targeting guide RNA
caauguccaccucgcuuuccuu

SEQ ID NO: 523 - RNA, 22 nt, Artificial Sequence
  CXCR4 targeting guide RNA
cagacucaguggaaacagauca

SEQ ID NO: 524 - RNA, 22 nt, Artificial Sequence
  CXCR4 targeting guide RNA
cagaucaauguccaccucgcuu

SEQ ID NO: 525 - RNA, 22 nt, Artificial Sequence
  CXCR4 targeting guide RNA
caguggaaacagaucaaugucc

SEQ ID NO: 526 - RNA, 22 nt, Artificial Sequence
  CXCR4 targeting guide RNA
cauugaucuguuuccacugagu

SEQ ID NO: 527 - RNA, 22 nt, Artificial Sequence
  CXCR4 targeting guide RNA
ccaaaggaaagcgagguggaca

SEQ ID NO: 528 - RNA, 22 nt, Artificial Sequence
  CXCR4 targeting guide RNA
cgagguggacauugaucuguuu

SEQ ID NO: 529 - RNA, 22 nt, Artificial Sequence
  CXCR4 targeting guide RNA
cucagacucaguggaaacagau

SEQ ID NO: 530 - RNA, 22 nt, Artificial Sequence
  CXCR4 targeting guide RNA
cucaguggaaacagaucaaugu

SEQ ID NO: 531 - RNA, 22 nt, Artificial Sequence
  CXCR4 targeting guide RNA
gaaacagaucaauguccaccuc

SEQ ID NO: 532 - RNA, 22 nt, Artificial Sequence
  CXCR4 targeting guide RNA
gaaagcgagguggacauugauc

SEQ ID NO: 533 - RNA, 22 nt, Artificial Sequence
  CXCR4 targeting guide RNA
gacauugaucuguuuccacuga

SEQ ID NO: 534 - RNA, 22 nt, Artificial Sequence
  CXCR4 targeting guide RNA
gacucagacucaguggaaacag

SEQ ID NO: 535 - RNA, 22 nt, Artificial Sequence
  CXCR4 targeting guide RNA
gacucaguggaaacagaucaau

SEQ ID NO: 536 - RNA, 22 nt, Artificial Sequence
  CXCR4 targeting guide RNA
gagguggacauugaucuguuuc

SEQ ID NO: 537 - RNA, 22 nt, Artificial Sequence
  CXCR4 targeting guide RNA
gaucaauguccaccucgcuuuc

SEQ ID NO: 538 - RNA, 22 nt, Artificial Sequence
  CXCR4 targeting guide RNA
gcgagguggacauugaucuguu

SEQ ID NO: 539 - RNA, 22 nt, Artificial Sequence
  CXCR4 targeting guide RNA
ggaaacagaucaauguccaccu

SEQ ID NO: 540 - RNA, 22 nt, Artificial Sequence
  CXCR4 targeting guide RNA
ggaaagcgagguggacauugau

SEQ ID NO: 541 - RNA, 22 nt, Artificial Sequence
  CXCR4 targeting guide RNA
ggacauugaucuguuuccacug

SEQ ID NO: 542 - RNA, 22 nt, Artificial Sequence
  CXCR4 targeting guide RNA
gguggacauugaucuguuucca

SEQ ID NO: 543 - RNA, 22 nt, Artificial Sequence
  CXCR4 targeting guide RNA
guggaaacagaucaauguccac

SEQ ID NO: 544 - RNA, 22 nt, Artificial Sequence
  CXCR4 targeting guide RNA
guggacauugaucuguuuccac

SEQ ID NO: 545 - RNA, 22 nt, Artificial Sequence
  CXCR4 targeting guide RNA
ucaauguccaccucgcuuuccu

SEQ ID NO: 546 - RNA, 22 nt, Artificial Sequence
  CXCR4 targeting guide RNA
ucagacucaguggaaacagauc

SEQ ID NO: 547 - RNA, 22 nt, Artificial Sequence
  CXCR4 targeting guide RNA
ucaguggaaacagaucaauguc

SEQ ID NO: 548 - RNA, 22 nt, Artificial Sequence
  CXCR4 targeting guide RNA
uccaaaggaaagcgagguggac

SEQ ID NO: 549 - RNA, 22 nt, Artificial Sequence
  CXCR4 targeting guide RNA
ugaucuguuuccacugagucug

SEQ ID NO: 550 - RNA, 22 nt, Artificial Sequence
  CXCR4 targeting guide RNA
uggaaacagaucaauguccacc

SEQ ID NO: 551 - RNA, 22 nt, Artificial Sequence
  CXCR4 targeting guide RNA
uggacauugaucuguuuccacu

SEQ ID NO: 552 - RNA, 22 nt, Artificial Sequence
  CXCR4 targeting guide RNA
uugaucuguuuccacugagucu

SEQ ID NO: 553 - RNA, 20 nt, Artificial Sequence
  CXCR4 targeting guide RNA
aaacagauuaauguccaccu

SEQ ID NO: 554 - RNA, 20 nt, Artificial Sequence
  CXCR4 targeting guide RNA
aaagcgagguggacauuaau

SEQ ID NO: 555 - RNA, 20 nt, Artificial Sequence
  CXCR4 targeting guide RNA
aacagauuaauguccaccuc

SEQ ID NO: 556 - RNA, 20 nt, Artificial Sequence
  CXCR4 targeting guide RNA
aagcgagguggacauuaauc

SEQ ID NO: 557 - RNA, 20 nt, Artificial Sequence
  CXCR4 targeting guide RNA
acagauuaauguccaccucg

SEQ ID NO: 558 - RNA, 20 nt, Artificial Sequence
  CXCR4 targeting guide RNA
acauuaaucuguuuccacug

SEQ ID NO: 559 - RNA, 20 nt, Artificial Sequence
  CXCR4 targeting guide RNA
acucaguggaaacagauuaa

SEQ ID NO: 560 - RNA, 20 nt, Artificial Sequence
  CXCR4 targeting guide RNA
agacucaguggaaacagauu

SEQ ID NO: 561 - RNA, 20 nt, Artificial Sequence
  CXCR4 targeting guide RNA
agauuaauguccaccucgcu

SEQ ID NO: 562 - RNA, 20 nt, Artificial Sequence
  CXCR4 targeting guide RNA
agcgagguggacauuaaucu

SEQ ID NO: 563 - RNA, 20 nt, Artificial Sequence
  CXCR4 targeting guide RNA
agguggacauuaaucuguuu

SEQ ID NO: 564 - RNA, 20 nt, Artificial Sequence
  CXCR4 targeting guide RNA
aguggaaacagauuaauguc

SEQ ID NO: 565 - RNA, 20 nt, Artificial Sequence
  CXCR4 targeting guide RNA
auuaaucuguuuccacugag

SEQ ID NO: 566 - RNA, 20 nt, Artificial Sequence
  CXCR4 targeting guide RNA
auuaauguccaccucgcuuu

SEQ ID NO: 567 - RNA, 20 nt, Artificial Sequence
  CXCR4 targeting guide RNA
cagauuaauguccaccucgc

SEQ ID NO: 568 - RNA, 20 nt, Artificial Sequence
  CXCR4 targeting guide RNA
caguggaaacagauuaaugu

SEQ ID NO: 569 - RNA, 20 nt, Artificial Sequence
  CXCR4 targeting guide RNA
cauuaaucuguuuccacuga

SEQ ID NO: 570 - RNA, 20 nt, Artificial Sequence
  CXCR4 targeting guide RNA
cgagguggacauuaaucugu

SEQ ID NO: 571 - RNA, 20 nt, Artificial Sequence
  CXCR4 targeting guide RNA
cucaguggaaacagauuaau

SEQ ID NO: 572 - RNA, 20 nt, Artificial Sequence
  CXCR4 targeting guide RNA
gaaacagauuaauguccacc

SEQ ID NO: 573 - RNA, 20 nt, Artificial Sequence
  CXCR4 targeting guide RNA
gaaagcgagguggacauuaa

SEQ ID NO: 574 - RNA, 20 nt, Artificial Sequence
  CXCR4 targeting guide RNA
gacauuaaucuguuuccacu

SEQ ID NO: 575 - RNA, 20 nt, Artificial Sequence
  CXCR4 targeting guide RNA
gacucaguggaaacagauua

SEQ ID NO: 576 - RNA, 20 nt, Artificial Sequence
  CXCR4 targeting guide RNA
gagguggacauuaaucuguu

SEQ ID NO: 577 - RNA, 20 nt, Artificial Sequence
  CXCR4 targeting guide RNA
gauuaauguccaccucgcuu

SEQ ID NO: 578 - RNA, 20 nt, Artificial Sequence
  CXCR4 targeting guide RNA
gcgagguggacauuaaucug

SEQ ID NO: 579 - RNA, 20 nt, Artificial Sequence
  CXCR4 targeting guide RNA
ggaaacagauuaauguccac

SEQ ID NO: 580 - RNA, 20 nt, Artificial Sequence
  CXCR4 targeting guide RNA
ggaaagcgagguggacauua

SEQ ID NO: 581 - RNA, 20 nt, Artificial Sequence
  CXCR4 targeting guide RNA
ggacauuaaucuguuuccac

SEQ ID NO: 582 - RNA, 20 nt, Artificial Sequence
  CXCR4 targeting guide RNA
gguggacauuaaucuguuuc

SEQ ID NO: 583 - RNA, 20 nt, Artificial Sequence
  CXCR4 targeting guide RNA
guggaaacagauuaaugucc

SEQ ID NO: 584 - RNA, 20 nt, Artificial Sequence
  CXCR4 targeting guide RNA
guggacauuaaucuguuucc

SEQ ID NO: 585 - RNA, 20 nt, Artificial Sequence
  CXCR4 targeting guide RNA
uaaucuguuuccacugaguc

SEQ ID NO: 586 - RNA, 20 nt, Artificial Sequence
  CXCR4 targeting guide RNA
uaauguccaccucgcuuucc

SEQ ID NO: 587 - RNA, 20 nt, Artificial Sequence
  CXCR4 targeting guide RNA
ucaguggaaacagauuaaug

SEQ ID NO: 588 - RNA, 20 nt, Artificial Sequence
  CXCR4 targeting guide RNA
uggaaacagauuaaugucca

SEQ ID NO: 589 - RNA, 20 nt, Artificial Sequence
  CXCR4 targeting guide RNA
uggacauuaaucuguuucca

SEQ ID NO: 590 - RNA, 20 nt, Artificial Sequence
  CXCR4 targeting guide RNA
uuaaucuguuuccacugagu

SEQ ID NO: 591 - RNA, 20 nt, Artificial Sequence
  CXCR4 targeting guide RNA
uuaauguccaccucgcuuuc

SEQ ID NO: 592 - RNA, 21 nt, Artificial Sequence
  CXCR4 targeting guide RNA
aaacagauuaauguccaccuc

SEQ ID NO: 593 - RNA, 21 nt, Artificial Sequence
  CXCR4 targeting guide RNA
aaagcgagguggacauuaauc

SEQ ID NO: 594 - RNA, 21 nt, Artificial Sequence
  CXCR4 targeting guide RNA
aacagauuaauguccaccucg

SEQ ID NO: 595 - RNA, 21 nt, Artificial Sequence
  CXCR4 targeting guide RNA
aagcgagguggacauuaaucu

SEQ ID NO: 596 - RNA, 21 nt, Artificial Sequence
  CXCR4 targeting guide RNA
acagauuaauguccaccucgc

SEQ ID NO: 597 - RNA, 21 nt, Artificial Sequence
  CXCR4 targeting guide RNA
acauuaaucuguuuccacuga

SEQ ID NO: 598 - RNA, 21 nt, Artificial Sequence
  CXCR4 targeting guide RNA
acucaguggaaacagauuaau

SEQ ID NO: 599 - RNA, 21 nt, Artificial Sequence
  CXCR4 targeting guide RNA
agacucaguggaaacagauua

SEQ ID NO: 600 - RNA, 21 nt, Artificial Sequence
  CXCR4 targeting guide RNA
agauuaauguccaccucgcuu

SEQ ID NO: 601 - RNA, 21 nt, Artificial Sequence
  CXCR4 targeting guide RNA
agcgagguggacauuaaucug

SEQ ID NO: 602 - RNA, 21 nt, Artificial Sequence
  CXCR4 targeting guide RNA
aggaaagcgagguggacauua

SEQ ID NO: 603 - RNA, 21 nt, Artificial Sequence
  CXCR4 targeting guide RNA
agguggacauuaaucuguuuc

SEQ ID NO: 604 - RNA, 21 nt, Artificial Sequence
  CXCR4 targeting guide RNA
aguggaaacagauuaaugucc

SEQ ID NO: 605 - RNA, 21 nt, Artificial Sequence
  CXCR4 targeting guide RNA
auuaaucuguuuccacugagu

SEQ ID NO: 606 - RNA, 21 nt, Artificial Sequence
  CXCR4 targeting guide RNA
auuaauguccaccucgcuuuc

SEQ ID NO: 607 - RNA, 21 nt, Artificial Sequence
  CXCR4 targeting guide RNA
cagacucaguggaaacagauu

SEQ ID NO: 608 - RNA, 21 nt, Artificial Sequence
  CXCR4 targeting guide RNA
cagauuaauguccaccucgcu

SEQ ID NO: 609 - RNA, 21 nt, Artificial Sequence
  CXCR4 targeting guide RNA
caguggaaacagauuaauguc

SEQ ID NO: 610 - RNA, 21 nt, Artificial Sequence
  CXCR4 targeting guide RNA
cauuaaucuguuuccacugag

SEQ ID NO: 611 - RNA, 21 nt, Artificial Sequence
  CXCR4 targeting guide RNA
cgagguggacauuaaucuguu

SEQ ID NO: 612 - RNA, 21 nt, Artificial Sequence
  CXCR4 targeting guide RNA
cucaguggaaacagauuaaug

SEQ ID NO: 613 - RNA, 21 nt, Artificial Sequence
  CXCR4 targeting guide RNA
gaaacagauuaauguccaccu

SEQ ID NO: 614 - RNA, 21 nt, Artificial Sequence
  CXCR4 targeting guide RNA
gaaagcgagguggacauuaau

SEQ ID NO: 615 - RNA, 21 nt, Artificial Sequence
  CXCR4 targeting guide RNA
gacauuaaucuguuuccacug

SEQ ID NO: 616 - RNA, 21 nt, Artificial Sequence
  CXCR4 targeting guide RNA
gacucaguggaaacagauuaa

SEQ ID NO: 617 - RNA, 21 nt, Artificial Sequence
  CXCR4 targeting guide RNA
gagguggacauuaaucuguuu

SEQ ID NO: 618 - RNA, 21 nt, Artificial Sequence
  CXCR4 targeting guide RNA
gauuaauguccaccucgcuuu

SEQ ID NO: 619 - RNA, 21 nt, Artificial Sequence
  CXCR4 targeting guide RNA
gcgagguggacauuaaucugu

SEQ ID NO: 620 - RNA, 21 nt, Artificial Sequence
  CXCR4 targeting guide RNA
ggaaacagauuaauguccacc

SEQ ID NO: 621 - RNA, 21 nt, Artificial Sequence
  CXCR4 targeting guide RNA
ggaaagcgagguggacauuaa

SEQ ID NO: 622 - RNA, 21 nt, Artificial Sequence
  CXCR4 targeting guide RNA
ggacauuaaucuguuuccacu

SEQ ID NO: 623 - RNA, 21 nt, Artificial Sequence
  CXCR4 targeting guide RNA
gguggacauuaaucuguuucc

SEQ ID NO: 624 - RNA, 21 nt, Artificial Sequence
  CXCR4 targeting guide RNA
guggaaacagauuaaugucca

SEQ ID NO: 625 - RNA, 21 nt, Artificial Sequence
  CXCR4 targeting guide RNA
guggacauuaaucuguuucca

SEQ ID NO: 626 - RNA, 21 nt, Artificial Sequence
  CXCR4 targeting guide RNA
uaaucuguuuccacugagucu

SEQ ID NO: 627 - RNA, 21 nt, Artificial Sequence
  CXCR4 targeting guide RNA
uaauguccaccucgcuuuccu

SEQ ID NO: 628 - RNA, 21 nt, Artificial Sequence
  CXCR4 targeting guide RNA
ucaguggaaacagauuaaugu

SEQ ID NO: 629 - RNA, 21 nt, Artificial Sequence
  CXCR4 targeting guide RNA
uggaaacagauuaauguccac

SEQ ID NO: 630 - RNA, 21 nt, Artificial Sequence
  CXCR4 targeting guide RNA
uggacauuaaucuguuuccac

SEQ ID NO: 631 - RNA, 21 nt, Artificial Sequence
  CXCR4 targeting guide RNA
uuaaucuguuuccacugaguc

SEQ ID NO: 632 - RNA, 21 nt, Artificial Sequence
  CXCR4 targeting guide RNA
uuaauguccaccucgcuuucc

SEQ ID NO: 633 - RNA, 22 nt, Artificial Sequence
  CXCR4 targeting guide RNA
aaacagauuaauguccaccucg

SEQ ID NO: 634 - RNA, 22 nt, Artificial Sequence
  CXCR4 targeting guide RNA
aaagcgagguggacauuaaucu

SEQ ID NO: 635 - RNA, 22 nt, Artificial Sequence
  CXCR4 targeting guide RNA
aacagauuaauguccaccucgc

SEQ ID NO: 636 - RNA, 22 nt, Artificial Sequence
  CXCR4 targeting guide RNA
aagcgagguggacauuaaucug

SEQ ID NO: 637 - RNA, 22 nt, Artificial Sequence
  CXCR4 targeting guide RNA
aaggaaagcgagguggacauua

SEQ ID NO: 638 - RNA, 22 nt, Artificial Sequence
  CXCR4 targeting guide RNA
acagauuaauguccaccucgcu

SEQ ID NO: 639 - RNA, 22 nt, Artificial Sequence
  CXCR4 targeting guide RNA
acauuaaucuguuuccacugag

SEQ ID NO: 640 - RNA, 22 nt, Artificial Sequence
  CXCR4 targeting guide RNA
acucaguggaaacagauuaaug

SEQ ID NO: 641 - RNA, 22 nt, Artificial Sequence
  CXCR4 targeting guide RNA
agacucaguggaaacagauuaa

SEQ ID NO: 642 - RNA, 22 nt, Artificial Sequence
  CXCR4 targeting guide RNA
agauuaauguccaccucgcuuu

SEQ ID NO: 643 - RNA, 22 nt, Artificial Sequence
  CXCR4 targeting guide RNA
agcgagguggacauuaaucugu

SEQ ID NO: 644 - RNA, 22 nt, Artificial Sequence
  CXCR4 targeting guide RNA
aggaaagcgagguggacauuaa

SEQ ID NO: 645 - RNA, 22 nt, Artificial Sequence
  CXCR4 targeting guide RNA
agguggacauuaaucuguuucc

SEQ ID NO: 646 - RNA, 22 nt, Artificial Sequence
  CXCR4 targeting guide RNA
aguggaaacagauuaaugucca

SEQ ID NO: 647 - RNA, 22 nt, Artificial Sequence
  CXCR4 targeting guide RNA
auuaaucuguuuccacugaguc

SEQ ID NO: 648 - RNA, 22 nt, Artificial Sequence
  CXCR4 targeting guide RNA
auuaauguccaccucgcuuucc

SEQ ID NO: 649 - RNA, 22 nt, Artificial Sequence
  CXCR4 targeting guide RNA
cagacucaguggaaacagauua

SEQ ID NO: 650 - RNA, 22 nt, Artificial Sequence
  CXCR4 targeting guide RNA
cagauuaauguccaccucgcuu

SEQ ID NO: 651 - RNA, 22 nt, Artificial Sequence
  CXCR4 targeting guide RNA
caguggaaacagauuaaugucc

SEQ ID NO: 652 - RNA, 22 nt, Artificial Sequence
  CXCR4 targeting guide RNA
cauuaaucuguuuccacugagu

SEQ ID NO: 653 - RNA, 22 nt, Artificial Sequence
  CXCR4 targeting guide RNA
cgagguggacauuaaucuguuu

SEQ ID NO: 654 - RNA, 22 nt, Artificial Sequence
  CXCR4 targeting guide RNA
cucaguggaaacagauuaaugu

SEQ ID NO: 655 - RNA, 22 nt, Artificial Sequence
  CXCR4 targeting guide RNA
gaaacagauuaauguccaccuc

SEQ ID NO: 656 - RNA, 22 nt, Artificial Sequence
  CXCR4 targeting guide RNA
gaaagcgagguggacauuaauc

SEQ ID NO: 657 - RNA, 22 nt, Artificial Sequence
  CXCR4 targeting guide RNA
gacauuaaucuguuuccacuga

SEQ ID NO: 658 - RNA, 22 nt, Artificial Sequence
  CXCR4 targeting guide RNA
gacucaguggaaacagauuaau

SEQ ID NO: 659 - RNA, 22 nt, Artificial Sequence
  CXCR4 targeting guide RNA
gagguggacauuaaucuguuuc

SEQ ID NO: 660 - RNA, 22 nt, Artificial Sequence
  CXCR4 targeting guide RNA
gauuaauguccaccucgcuuuc

SEQ ID NO: 661 - RNA, 22 nt, Artificial Sequence
  CXCR4 targeting guide RNA
gcgagguggacauuaaucuguu

SEQ ID NO: 662 - RNA, 22 nt, Artificial Sequence
  CXCR4 targeting guide RNA
ggaaacagauuaauguccaccu

SEQ ID NO: 663 - RNA, 22 nt, Artificial Sequence
  CXCR4 targeting guide RNA
ggaaagcgagguggacauuaau

SEQ ID NO: 664 - RNA, 22 nt, Artificial Sequence
  CXCR4 targeting guide RNA
ggacauuaaucuguuuccacug

SEQ ID NO: 665 - RNA, 22 nt, Artificial Sequence
  CXCR4 targeting guide RNA
gguggacauuaaucuguuucca

SEQ ID NO: 666 - RNA, 22 nt, Artificial Sequence
  CXCR4 targeting guide RNA
guggaaacagauuaauguccac

SEQ ID NO: 667 - RNA, 22 nt, Artificial Sequence
  CXCR4 targeting guide RNA
guggacauuaaucuguuuccac

SEQ ID NO: 668 - RNA, 22 nt, Artificial Sequence
  CXCR4 targeting guide RNA
uaaucuguuuccacugagucug

SEQ ID NO: 669 - RNA, 22 nt, Artificial Sequence
  CXCR4 targeting guide RNA
uaauguccaccucgcuuuccuu

SEQ ID NO: 670 - RNA, 22 nt, Artificial Sequence
  CXCR4 targeting guide RNA
ucagacucaguggaaacagauu

SEQ ID NO: 671 - RNA, 22 nt, Artificial Sequence
  CXCR4 targeting guide RNA
ucaguggaaacagauuaauguc

SEQ ID NO: 672 - RNA, 22 nt, Artificial Sequence
  CXCR4 targeting guide RNA
uggaaacagauuaauguccacc

SEQ ID NO: 673 - RNA, 22 nt, Artificial Sequence
  CXCR4 targeting guide RNA
uggacauuaaucuguuuccacu

SEQ ID NO: 674 - RNA, 22 nt, Artificial Sequence
  CXCR4 targeting guide RNA
uuaaucuguuuccacugagucu

SEQ ID NO: 675 - RNA, 22 nt, Artificial Sequence
  CXCR4 targeting guide RNA
uuaauguccaccucgcuuuccu

SEQ ID NO: 676 - RNA, 20 nt, Artificial Sequence
  CXCR4 targeting guide RNA
aaacagaugaaugucaaccu

SEQ ID NO: 677 - RNA, 20 nt, Artificial Sequence
  CXCR4 targeting guide RNA
aaagcgagguugacauucau

SEQ ID NO: 678 - RNA, 20 nt, Artificial Sequence
  CXCR4 targeting guide RNA
aaaggaaagcgagguugaca

SEQ ID NO: 679 - RNA, 20 nt, Artificial Sequence
  CXCR4 targeting guide RNA
aacagaugaaugucaaccuc

SEQ ID NO: 680 - RNA, 20 nt, Artificial Sequence
  CXCR4 targeting guide RNA
aaccucgcuuuccuuuggag

SEQ ID NO: 681 - RNA, 20 nt, Artificial Sequence
  CXCR4 targeting guide RNA
aagcgagguugacauucauc

SEQ ID NO: 682 - RNA, 20 nt, Artificial Sequence
  CXCR4 targeting guide RNA
aaggaaagcgagguugacau

SEQ ID NO: 683 - RNA, 20 nt, Artificial Sequence
  CXCR4 targeting guide RNA
aaugucaaccucgcuuuccu

SEQ ID NO: 684 - RNA, 20 nt, Artificial Sequence
  CXCR4 targeting guide RNA
acagaugaaugucaaccucg

SEQ ID NO: 685 - RNA, 20 nt, Artificial Sequence
  CXCR4 targeting guide RNA
agaugaaugucaaccucgcu

SEQ ID NO: 686 - RNA, 20 nt, Artificial Sequence
  CXCR4 targeting guide RNA
agcgagguugacauucaucu

SEQ ID NO: 687 - RNA, 20 nt, Artificial Sequence
  CXCR4 targeting guide RNA
aggaaagcgagguugacauu

SEQ ID NO: 688 - RNA, 20 nt, Artificial Sequence
  CXCR4 targeting guide RNA
agguugacauucaucuguuu

SEQ ID NO: 689 - RNA, 20 nt, Artificial Sequence
  CXCR4 targeting guide RNA
aguggaaacagaugaauguc

SEQ ID NO: 690 - RNA, 20 nt, Artificial Sequence
  CXCR4 targeting guide RNA
augaaugucaaccucgcuuu

SEQ ID NO: 691 - RNA, 20 nt, Artificial Sequence
  CXCR4 targeting guide RNA
augucaaccucgcuuuccuu

SEQ ID NO: 692 - RNA, 20 nt, Artificial Sequence
  CXCR4 targeting guide RNA
caaaggaaagcgagguugac

SEQ ID NO: 693 - RNA, 20 nt, Artificial Sequence
  CXCR4 targeting guide RNA
caaccucgcuuuccuuugga

SEQ ID NO: 694 - RNA, 20 nt, Artificial Sequence
  CXCR4 targeting guide RNA
cagaugaaugucaaccucgc

SEQ ID NO: 695 - RNA, 20 nt, Artificial Sequence
  CXCR4 targeting guide RNA
caguggaaacagaugaaugu

SEQ ID NO: 696 - RNA, 20 nt, Artificial Sequence
  CXCR4 targeting guide RNA
ccaaaggaaagcgagguuga

SEQ ID NO: 697 - RNA, 20 nt, Artificial Sequence
  CXCR4 targeting guide RNA
ccucuccaaaggaaagcgag

SEQ ID NO: 698 - RNA, 20 nt, Artificial Sequence
  CXCR4 targeting guide RNA
cgagguugacauucaucugu

SEQ ID NO: 699 - RNA, 20 nt, Artificial Sequence
  CXCR4 targeting guide RNA
cuccaaaggaaagcgagguu

SEQ ID NO: 700 - RNA, 20 nt, Artificial Sequence
  CXCR4 targeting guide RNA
cucuccaaaggaaagcgagg

SEQ ID NO: 701 - RNA, 20 nt, Artificial Sequence
  CXCR4 targeting guide RNA
gaaacagaugaaugucaacc

SEQ ID NO: 702 - RNA, 20 nt, Artificial Sequence
  CXCR4 targeting guide RNA
gaaagcgagguugacauuca

SEQ ID NO: 703 - RNA, 20 nt, Artificial Sequence
  CXCR4 targeting guide RNA
gaaugucaaccucgcuuucc

SEQ ID NO: 704 - RNA, 20 nt, Artificial Sequence
  CXCR4 targeting guide RNA
gagguugacauucaucuguu

SEQ ID NO: 705 - RNA, 20 nt, Artificial Sequence
  CXCR4 targeting guide RNA
gaugaaugucaaccucgcuu

SEQ ID NO: 706 - RNA, 20 nt, Artificial Sequence
  CXCR4 targeting guide RNA
gcgagguugacauucaucug

SEQ ID NO: 707 - RNA, 20 nt, Artificial Sequence
  CXCR4 targeting guide RNA
ggaaacagaugaaugucaac

SEQ ID NO: 708 - RNA, 20 nt, Artificial Sequence
  CXCR4 targeting guide RNA
ggaaagcgagguugacauuc

SEQ ID NO: 709 - RNA, 20 nt, Artificial Sequence
  CXCR4 targeting guide RNA
gguugacauucaucuguuuc

SEQ ID NO: 710 - RNA, 20 nt, Artificial Sequence
  CXCR4 targeting guide RNA
gucaaccucgcuuuccuuug

SEQ ID NO: 711 - RNA, 20 nt, Artificial Sequence
  CXCR4 targeting guide RNA
guggaaacagaugaauguca

SEQ ID NO: 712 - RNA, 20 nt, Artificial Sequence
  CXCR4 targeting guide RNA
guugacauucaucuguuucc

SEQ ID NO: 713 - RNA, 20 nt, Artificial Sequence
  CXCR4 targeting guide RNA
ucaaccucgcuuuccuuugg

SEQ ID NO: 714 - RNA, 20 nt, Artificial Sequence
  CXCR4 targeting guide RNA
ucaguggaaacagaugaaug

SEQ ID NO: 715 - RNA, 20 nt, Artificial Sequence
  CXCR4 targeting guide RNA
uccaaaggaaagcgagguug

SEQ ID NO: 716 - RNA, 20 nt, Artificial Sequence
  CXCR4 targeting guide RNA
uccucuccaaaggaaagcga

SEQ ID NO: 717 - RNA, 20 nt, Artificial Sequence
  CXCR4 targeting guide RNA
ucuccaaaggaaagcgaggu

SEQ ID NO: 718 - RNA, 20 nt, Artificial Sequence
  CXCR4 targeting guide RNA
ugaaugucaaccucgcuuuc

SEQ ID NO: 719 - RNA, 20 nt, Artificial Sequence
  CXCR4 targeting guide RNA
uggaaacagaugaaugucaa

SEQ ID NO: 720 - RNA, 20 nt, Artificial Sequence
  CXCR4 targeting guide RNA
ugucaaccucgcuuuccuuu

SEQ ID NO: 721 - RNA, 20 nt, Artificial Sequence
  CXCR4 targeting guide RNA
uugacauucaucuguuucca

SEQ ID NO: 722 - RNA, 21 nt, Artificial Sequence
  CXCR4 targeting guide RNA
aaacagaugaaugucaaccuc

SEQ ID NO: 723 - RNA, 21 nt, Artificial Sequence
  CXCR4 targeting guide RNA
aaagcgagguugacauucauc

SEQ ID NO: 724 - RNA, 21 nt, Artificial Sequence
  CXCR4 targeting guide RNA
aaaggaaagcgagguugacau

SEQ ID NO: 725 - RNA, 21 nt, Artificial Sequence
  CXCR4 targeting guide RNA
aacagaugaaugucaaccucg

SEQ ID NO: 726 - RNA, 21 nt, Artificial Sequence
  CXCR4 targeting guide RNA
aaccucgcuuuccuuuggaga

SEQ ID NO: 727 - RNA, 21 nt, Artificial Sequence
  CXCR4 targeting guide RNA
aagcgagguugacauucaucu

SEQ ID NO: 728 - RNA, 21 nt, Artificial Sequence
  CXCR4 targeting guide RNA
aaggaaagcgagguugacauu

SEQ ID NO: 729 - RNA, 21 nt, Artificial Sequence
  CXCR4 targeting guide RNA
aaugucaaccucgcuuuccuu

SEQ ID NO: 730 - RNA, 21 nt, Artificial Sequence
  CXCR4 targeting guide RNA
acagaugaaugucaaccucgc

SEQ ID NO: 731 - RNA, 21 nt, Artificial Sequence
  CXCR4 targeting guide RNA
agaugaaugucaaccucgcuu

SEQ ID NO: 732 - RNA, 21 nt, Artificial Sequence
  CXCR4 targeting guide RNA
agcgagguugacauucaucug

SEQ ID NO: 733 - RNA, 21 nt, Artificial Sequence
  CXCR4 targeting guide RNA
aggaaagcgagguugacauuc

SEQ ID NO: 734 - RNA, 21 nt, Artificial Sequence
  CXCR4 targeting guide RNA
agguugacauucaucuguuuc

SEQ ID NO: 735 - RNA, 21 nt, Artificial Sequence
  CXCR4 targeting guide RNA
aguggaaacagaugaauguca

SEQ ID NO: 736 - RNA, 21 nt, Artificial Sequence
  CXCR4 targeting guide RNA
auccucuccaaaggaaagcga

SEQ ID NO: 737 - RNA, 21 nt, Artificial Sequence
  CXCR4 targeting guide RNA
augaaugucaaccucgcuuuc

SEQ ID NO: 738 - RNA, 21 nt, Artificial Sequence
  CXCR4 targeting guide RNA
augucaaccucgcuuuccuuu

SEQ ID NO: 739 - RNA, 21 nt, Artificial Sequence
  CXCR4 targeting guide RNA
caaaggaaagcgagguugaca

SEQ ID NO: 740 - RNA, 21 nt, Artificial Sequence
  CXCR4 targeting guide RNA
caaccucgcuuuccuuuggag

SEQ ID NO: 741 - RNA, 21 nt, Artificial Sequence
  CXCR4 targeting guide RNA
cagaugaaugucaaccucgcu

SEQ ID NO: 742 - RNA, 21 nt, Artificial Sequence
  CXCR4 targeting guide RNA
caguggaaacagaugaauguc

SEQ ID NO: 743 - RNA, 21 nt, Artificial Sequence
  CXCR4 targeting guide RNA
ccaaaggaaagcgagguugac

SEQ ID NO: 744 - RNA, 21 nt, Artificial Sequence
  CXCR4 targeting guide RNA
ccucuccaaaggaaagcgagg

SEQ ID NO: 745 - RNA, 21 nt, Artificial Sequence
  CXCR4 targeting guide RNA
cgagguugacauucaucuguu

SEQ ID NO: 746 - RNA, 21 nt, Artificial Sequence
  CXCR4 targeting guide RNA
cucaguggaaacagaugaaug

SEQ ID NO: 747 - RNA, 21 nt, Artificial Sequence
  CXCR4 targeting guide RNA
cuccaaaggaaagcgagguug

SEQ ID NO: 748 - RNA, 21 nt, Artificial Sequence
  CXCR4 targeting guide RNA
cucuccaaaggaaagcgaggu

SEQ ID NO: 749 - RNA, 21 nt, Artificial Sequence
  CXCR4 targeting guide RNA
gaaacagaugaaugucaaccu

SEQ ID NO: 750 - RNA, 21 nt, Artificial Sequence
  CXCR4 targeting guide RNA
gaaagcgagguugacauucau

SEQ ID NO: 751 - RNA, 21 nt, Artificial Sequence
  CXCR4 targeting guide RNA
gaaugucaaccucgcuuuccu

SEQ ID NO: 752 - RNA, 21 nt, Artificial Sequence
  CXCR4 targeting guide RNA
gagguugacauucaucuguuu

SEQ ID NO: 753 - RNA, 21 nt, Artificial Sequence
  CXCR4 targeting guide RNA
gaugaaugucaaccucgcuuu

SEQ ID NO: 754 - RNA, 21 nt, Artificial Sequence
  CXCR4 targeting guide RNA
gcgagguugacauucaucugu

SEQ ID NO: 755 - RNA, 21 nt, Artificial Sequence
  CXCR4 targeting guide RNA
ggaaacagaugaaugucaacc

SEQ ID NO: 756 - RNA, 21 nt, Artificial Sequence
  CXCR4 targeting guide RNA
ggaaagcgagguugacauuca

SEQ ID NO: 757 - RNA, 21 nt, Artificial Sequence
  CXCR4 targeting guide RNA
gguugacauucaucuguuucc

SEQ ID NO: 758 - RNA, 21 nt, Artificial Sequence
  CXCR4 targeting guide RNA
gucaaccucgcuuuccuuugg

SEQ ID NO: 759 - RNA, 21 nt, Artificial Sequence
  CXCR4 targeting guide RNA
guggaaacagaugaaugucaa

SEQ ID NO: 760 - RNA, 21 nt, Artificial Sequence
  CXCR4 targeting guide RNA
guugacauucaucuguuucca

SEQ ID NO: 761 - RNA, 21 nt, Artificial Sequence
  CXCR4 targeting guide RNA
ucaaccucgcuuuccuuugga

SEQ ID NO: 762 - RNA, 21 nt, Artificial Sequence
  CXCR4 targeting guide RNA
ucaguggaaacagaugaaugu

SEQ ID NO: 763 - RNA, 21 nt, Artificial Sequence
  CXCR4 targeting guide RNA
uccaaaggaaagcgagguuga

SEQ ID NO: 764 - RNA, 21 nt, Artificial Sequence
  CXCR4 targeting guide RNA
uccucuccaaaggaaagcgag

SEQ ID NO: 765 - RNA, 21 nt, Artificial Sequence
  CXCR4 targeting guide RNA
ucuccaaaggaaagcgagguu

SEQ ID NO: 766 - RNA, 21 nt, Artificial Sequence
  CXCR4 targeting guide RNA
ugaaugucaaccucgcuuucc

SEQ ID NO: 767 - RNA, 21 nt, Artificial Sequence
  CXCR4 targeting guide RNA
uggaaacagaugaaugucaac

SEQ ID NO: 768 - RNA, 21 nt, Artificial Sequence
  CXCR4 targeting guide RNA
ugucaaccucgcuuuccuuug

SEQ ID NO: 769 - RNA, 21 nt, Artificial Sequence
  CXCR4 targeting guide RNA
uugacauucaucuguuuccac

SEQ ID NO: 770 - RNA, 22 nt, Artificial Sequence
  CXCR4 targeting guide RNA
aaacagaugaaugucaaccucg

SEQ ID NO: 771 - RNA, 22 nt, Artificial Sequence
  CXCR4 targeting guide RNA
aaagcgagguugacauucaucu

SEQ ID NO: 772 - RNA, 22 nt, Artificial Sequence
  CXCR4 targeting guide RNA
aaaggaaagcgagguugacauu

SEQ ID NO: 773 - RNA, 22 nt, Artificial Sequence
  CXCR4 targeting guide RNA
aacagaugaaugucaaccucgc

SEQ ID NO: 774 - RNA, 22 nt, Artificial Sequence
  CXCR4 targeting guide RNA
aaccucgcuuuccuuuggagag

SEQ ID NO: 775 - RNA, 22 nt, Artificial Sequence
  CXCR4 targeting guide RNA
aagcgagguugacauucaucug

SEQ ID NO: 776 - RNA, 22 nt, Artificial Sequence
  CXCR4 targeting guide RNA
aaggaaagcgagguugacauuc

SEQ ID NO: 777 - RNA, 22 nt, Artificial Sequence
  CXCR4 targeting guide RNA
aaugucaaccucgcuuuccuuu

SEQ ID NO: 778 - RNA, 22 nt, Artificial Sequence
  CXCR4 targeting guide RNA
acagaugaaugucaaccucgcu

SEQ ID NO: 779 - RNA, 22 nt, Artificial Sequence
  CXCR4 targeting guide RNA
acucaguggaaacagaugaaug

SEQ ID NO: 780 - RNA, 22 nt, Artificial Sequence
  CXCR4 targeting guide RNA
agaugaaugucaaccucgcuuu

SEQ ID NO: 781 - RNA, 22 nt, Artificial Sequence
  CXCR4 targeting guide RNA
agcgagguugacauucaucugu

SEQ ID NO: 782 - RNA, 22 nt, Artificial Sequence
  CXCR4 targeting guide RNA
aggaaagcgagguugacauuca

SEQ ID NO: 783 - RNA, 22 nt, Artificial Sequence
  CXCR4 targeting guide RNA
agguugacauucaucuguuucc

SEQ ID NO: 784 - RNA, 22 nt, Artificial Sequence
  CXCR4 targeting guide RNA
aguggaaacagaugaaugucaa

SEQ ID NO: 785 - RNA, 22 nt, Artificial Sequence
  CXCR4 targeting guide RNA
auccucuccaaaggaaagcgag

SEQ ID NO: 786 - RNA, 22 nt, Artificial Sequence
  CXCR4 targeting guide RNA
augaaugucaaccucgcuuucc

SEQ ID NO: 787 - RNA, 22 nt, Artificial Sequence
  CXCR4 targeting guide RNA
augucaaccucgcuuuccuuug

SEQ ID NO: 788 - RNA, 22 nt, Artificial Sequence
  CXCR4 targeting guide RNA
caaaggaaagcgagguugacau

SEQ ID NO: 789 - RNA, 22 nt, Artificial Sequence
  CXCR4 targeting guide RNA
caaccucgcuuuccuuuggaga

SEQ ID NO: 790 - RNA, 22 nt, Artificial Sequence
  CXCR4 targeting guide RNA
cagaugaaugucaaccucgcuu

SEQ ID NO: 791 - RNA, 22 nt, Artificial Sequence
  CXCR4 targeting guide RNA
caguggaaacagaugaauguca

SEQ ID NO: 792 - RNA, 22 nt, Artificial Sequence
  CXCR4 targeting guide RNA
ccaaaggaaagcgagguugaca

SEQ ID NO: 793 - RNA, 22 nt, Artificial Sequence
  CXCR4 targeting guide RNA
ccucuccaaaggaaagcgaggu

SEQ ID NO: 794 - RNA, 22 nt, Artificial Sequence
  CXCR4 targeting guide RNA
cgagguugacauucaucuguuu

SEQ ID NO: 795 - RNA, 22 nt, Artificial Sequence
  CXCR4 targeting guide RNA
cucaguggaaacagaugaaugu

SEQ ID NO: 796 - RNA, 22 nt, Artificial Sequence
  CXCR4 targeting guide RNA
cuccaaaggaaagcgagguuga

SEQ ID NO: 797 - RNA, 22 nt, Artificial Sequence
  CXCR4 targeting guide RNA
cucuccaaaggaaagcgagguu

SEQ ID NO: 798 - RNA, 22 nt, Artificial Sequence
  CXCR4 targeting guide RNA
gaaacagaugaaugucaaccuc

SEQ ID NO: 799 - RNA, 22 nt, Artificial Sequence
  CXCR4 targeting guide RNA
gaaagcgagguugacauucauc

SEQ ID NO: 800 - RNA, 22 nt, Artificial Sequence
  CXCR4 targeting guide RNA
gaaugucaaccucgcuuuccuu

SEQ ID NO: 801 - RNA, 22 nt, Artificial Sequence
  CXCR4 targeting guide RNA
gagguugacauucaucuguuuc

SEQ ID NO: 802 - RNA, 22 nt, Artificial Sequence
  CXCR4 targeting guide RNA
gauccucuccaaaggaaagcga

SEQ ID NO: 803 - RNA, 22 nt, Artificial Sequence
  CXCR4 targeting guide RNA
gaugaaugucaaccucgcuuuc

SEQ ID NO: 804 - RNA, 22 nt, Artificial Sequence
  CXCR4 targeting guide RNA
gcgagguugacauucaucuguu

SEQ ID NO: 805 - RNA, 22 nt, Artificial Sequence
  CXCR4 targeting guide RNA
ggaaacagaugaaugucaaccu

SEQ ID NO: 806 - RNA, 22 nt, Artificial Sequence
  CXCR4 targeting guide RNA
ggaaagcgagguugacauucau

SEQ ID NO: 807 - RNA, 22 nt, Artificial Sequence
  CXCR4 targeting guide RNA
gguugacauucaucuguuucca

SEQ ID NO: 808 - RNA, 22 nt, Artificial Sequence
  CXCR4 targeting guide RNA
gucaaccucgcuuuccuuugga

SEQ ID NO: 809 - RNA, 22 nt, Artificial Sequence
  CXCR4 targeting guide RNA
guggaaacagaugaaugucaac

SEQ ID NO: 810 - RNA, 22 nt, Artificial Sequence
  CXCR4 targeting guide RNA
guugacauucaucuguuuccac

SEQ ID NO: 811 - RNA, 22 nt, Artificial Sequence
  CXCR4 targeting guide RNA
ucaaccucgcuuuccuuuggag

SEQ ID NO: 812 - RNA, 22 nt, Artificial Sequence
  CXCR4 targeting guide RNA
ucaguggaaacagaugaauguc

SEQ ID NO: 813 - RNA, 22 nt, Artificial Sequence
  CXCR4 targeting guide RNA
uccaaaggaaagcgagguugac

SEQ ID NO: 814 - RNA, 22 nt, Artificial Sequence
  CXCR4 targeting guide RNA
uccucuccaaaggaaagcgagg

SEQ ID NO: 815 - RNA, 22 nt, Artificial Sequence
  CXCR4 targeting guide RNA
ucuccaaaggaaagcgagguug

SEQ ID NO: 816 - RNA, 22 nt, Artificial Sequence
  CXCR4 targeting guide RNA
ugaaugucaaccucgcuuuccu

SEQ ID NO: 817 - RNA, 22 nt, Artificial Sequence
  CXCR4 targeting guide RNA
uggaaacagaugaaugucaacc

SEQ ID NO: 818 - RNA, 22 nt, Artificial Sequence
  CXCR4 targeting guide RNA
ugucaaccucgcuuuccuuugg

SEQ ID NO: 819 - RNA, 22 nt, Artificial Sequence
  CXCR4 targeting guide RNA
uugacauucaucuguuuccacu

SEQ ID NO: 820 - RNA, 20 nt, Artificial Sequence
  CXCR4 targeting guide RNA
aaacagaugaauguccacuu

SEQ ID NO: 821 - RNA, 20 nt, Artificial Sequence
  CXCR4 targeting guide RNA
aaagcgaaguggacauucau

SEQ ID NO: 822 - RNA, 20 nt, Artificial Sequence
  CXCR4 targeting guide RNA
aaaggaaagcgaaguggaca

SEQ ID NO: 823 - RNA, 20 nt, Artificial Sequence
  CXCR4 targeting guide RNA
aacagaugaauguccacuuc

SEQ ID NO: 824 - RNA, 20 nt, Artificial Sequence
  CXCR4 targeting guide RNA
aagcgaaguggacauucauc

SEQ ID NO: 825 - RNA, 20 nt, Artificial Sequence
  CXCR4 targeting guide RNA
aaggaaagcgaaguggacau

SEQ ID NO: 826 - RNA, 20 nt, Artificial Sequence
  CXCR4 targeting guide RNA
aaguggacauucaucuguuu

SEQ ID NO: 827 - RNA, 20 nt, Artificial Sequence
  CXCR4 targeting guide RNA
aauguccacuucgcuuuccu

SEQ ID NO: 828 - RNA, 20 nt, Artificial Sequence
  CXCR4 targeting guide RNA
acagaugaauguccacuucg

SEQ ID NO: 829 - RNA, 20 nt, Artificial Sequence
  CXCR4 targeting guide RNA
acuucgcuuuccuuuggaga

SEQ ID NO: 830 - RNA, 20 nt, Artificial Sequence
  CXCR4 targeting guide RNA
agauccucuccaaaggaaag

SEQ ID NO: 831 - RNA, 20 nt, Artificial Sequence
  CXCR4 targeting guide RNA
agaugaauguccacuucgcu

SEQ ID NO: 832 - RNA, 20 nt, Artificial Sequence
  CXCR4 targeting guide RNA
agcgaaguggacauucaucu

SEQ ID NO: 833 - RNA, 20 nt, Artificial Sequence
  CXCR4 targeting guide RNA
aggaaagcgaaguggacauu

SEQ ID NO: 834 - RNA, 20 nt, Artificial Sequence
  CXCR4 targeting guide RNA
auccucuccaaaggaaagcg

SEQ ID NO: 835 - RNA, 20 nt, Artificial Sequence
  CXCR4 targeting guide RNA
augaauguccacuucgcuuu

SEQ ID NO: 836 - RNA, 20 nt, Artificial Sequence
  CXCR4 targeting guide RNA
auguccacuucgcuuuccuu

SEQ ID NO: 837 - RNA, 20 nt, Artificial Sequence
  CXCR4 targeting guide RNA
caaaggaaagcgaaguggac

SEQ ID NO: 838 - RNA, 20 nt, Artificial Sequence
  CXCR4 targeting guide RNA
cacuucgcuuuccuuuggag

SEQ ID NO: 839 - RNA, 20 nt, Artificial Sequence
  CXCR4 targeting guide RNA
cagaugaauguccacuucgc

SEQ ID NO: 840 - RNA, 20 nt, Artificial Sequence
  CXCR4 targeting guide RNA
ccaaaggaaagcgaagugga

SEQ ID NO: 841 - RNA, 20 nt, Artificial Sequence
  CXCR4 targeting guide RNA
ccacuucgcuuuccuuugga

SEQ ID NO: 842 - RNA, 20 nt, Artificial Sequence
  CXCR4 targeting guide RNA
ccucuccaaaggaaagcgaa

SEQ ID NO: 843 - RNA, 20 nt, Artificial Sequence
  CXCR4 targeting guide RNA
cgaaguggacauucaucugu

SEQ ID NO: 844 - RNA, 20 nt, Artificial Sequence
  CXCR4 targeting guide RNA
cuccaaaggaaagcgaagug

SEQ ID NO: 845 - RNA, 20 nt, Artificial Sequence
  CXCR4 targeting guide RNA
cucuccaaaggaaagcgaag

SEQ ID NO: 846 - RNA, 20 nt, Artificial Sequence
  CXCR4 targeting guide RNA
cuucgcuuuccuuuggagag

SEQ ID NO: 847 - RNA, 20 nt, Artificial Sequence
  CXCR4 targeting guide RNA
gaaacagaugaauguccacu

SEQ ID NO: 848 - RNA, 20 nt, Artificial Sequence
  CXCR4 targeting guide RNA
gaaagcgaaguggacauuca

SEQ ID NO: 849 - RNA, 20 nt, Artificial Sequence
  CXCR4 targeting guide RNA
gaaguggacauucaucuguu

SEQ ID NO: 850 - RNA, 20 nt, Artificial Sequence
  CXCR4 targeting guide RNA
gaauguccacuucgcuuucc

SEQ ID NO: 851 - RNA, 20 nt, Artificial Sequence
  CXCR4 targeting guide RNA
gauccucuccaaaggaaagc

SEQ ID NO: 852 - RNA, 20 nt, Artificial Sequence
  CXCR4 targeting guide RNA
gaugaauguccacuucgcuu

SEQ ID NO: 853 - RNA, 20 nt, Artificial Sequence
  CXCR4 targeting guide RNA
gcgaaguggacauucaucug

SEQ ID NO: 854 - RNA, 20 nt, Artificial Sequence
  CXCR4 targeting guide RNA
ggaaacagaugaauguccac

SEQ ID NO: 855 - RNA, 20 nt, Artificial Sequence
  CXCR4 targeting guide RNA
ggaaagcgaaguggacauuc

SEQ ID NO: 856 - RNA, 20 nt, Artificial Sequence
  CXCR4 targeting guide RNA
guccacuucgcuuuccuuug

SEQ ID NO: 857 - RNA, 20 nt, Artificial Sequence
  CXCR4 targeting guide RNA
guggaaacagaugaaugucc

SEQ ID NO: 858 - RNA, 20 nt, Artificial Sequence
  CXCR4 targeting guide RNA
uccaaaggaaagcgaagugg

SEQ ID NO: 859 - RNA, 20 nt, Artificial Sequence
  CXCR4 targeting guide RNA
uccacuucgcuuuccuuugg

SEQ ID NO: 860 - RNA, 20 nt, Artificial Sequence
  CXCR4 targeting guide RNA
ucuccaaaggaaagcgaagu

SEQ ID NO: 861 - RNA, 20 nt, Artificial Sequence
  CXCR4 targeting guide RNA
ugaauguccacuucgcuuuc

SEQ ID NO: 862 - RNA, 20 nt, Artificial Sequence
  CXCR4 targeting guide RNA
uggaaacagaugaaugucca

SEQ ID NO: 863 - RNA, 20 nt, Artificial Sequence
  CXCR4 targeting guide RNA
uguccacuucgcuuuccuuu

SEQ ID NO: 864 - RNA, 20 nt, Artificial Sequence
  CXCR4 targeting guide RNA
uucgcuuuccuuuggagagg

SEQ ID NO: 865 - RNA, 21 nt, Artificial Sequence
  CXCR4 targeting guide RNA
aaacagaugaauguccacuuc

SEQ ID NO: 866 - RNA, 21 nt, Artificial Sequence
  CXCR4 targeting guide RNA
aaagcgaaguggacauucauc

SEQ ID NO: 867 - RNA, 21 nt, Artificial Sequence
  CXCR4 targeting guide RNA
aaaggaaagcgaaguggacau

SEQ ID NO: 868 - RNA, 21 nt, Artificial Sequence
  CXCR4 targeting guide RNA
aacagaugaauguccacuucg

SEQ ID NO: 869 - RNA, 21 nt, Artificial Sequence
  CXCR4 targeting guide RNA
aagauccucuccaaaggaaag

SEQ ID NO: 870 - RNA, 21 nt, Artificial Sequence
  CXCR4 targeting guide RNA
aagcgaaguggacauucaucu

SEQ ID NO: 871 - RNA, 21 nt, Artificial Sequence
  CXCR4 targeting guide RNA
aaggaaagcgaaguggacauu

SEQ ID NO: 872 - RNA, 21 nt, Artificial Sequence
  CXCR4 targeting guide RNA
aaguggacauucaucuguuuc

SEQ ID NO: 873 - RNA, 21 nt, Artificial Sequence
  CXCR4 targeting guide RNA
aauguccacuucgcuuuccuu

SEQ ID NO: 874 - RNA, 21 nt, Artificial Sequence
  CXCR4 targeting guide RNA
acagaugaauguccacuucgc

SEQ ID NO: 875 - RNA, 21 nt, Artificial Sequence
  CXCR4 targeting guide RNA
acuucgcuuuccuuuggagag

SEQ ID NO: 876 - RNA, 21 nt, Artificial Sequence
  CXCR4 targeting guide RNA
agauccucuccaaaggaaagc

SEQ ID NO: 877 - RNA, 21 nt, Artificial Sequence
  CXCR4 targeting guide RNA
agaugaauguccacuucgcuu

SEQ ID NO: 878 - RNA, 21 nt, Artificial Sequence
  CXCR4 targeting guide RNA
agcgaaguggacauucaucug

SEQ ID NO: 879 - RNA, 21 nt, Artificial Sequence
  CXCR4 targeting guide RNA
aggaaagcgaaguggacauuc

SEQ ID NO: 880 - RNA, 21 nt, Artificial Sequence
  CXCR4 targeting guide RNA
aguggaaacagaugaaugucc

SEQ ID NO: 881 - RNA, 21 nt, Artificial Sequence
  CXCR4 targeting guide RNA
augaauguccacuucgcuuuc

SEQ ID NO: 882 - RNA, 21 nt, Artificial Sequence
  CXCR4 targeting guide RNA
auguccacuucgcuuuccuuu

SEQ ID NO: 883 - RNA, 21 nt, Artificial Sequence
  CXCR4 targeting guide RNA
caaaggaaagcgaaguggaca

SEQ ID NO: 884 - RNA, 21 nt, Artificial Sequence
  CXCR4 targeting guide RNA
cacuucgcuuuccuuuggaga

SEQ ID NO: 885 - RNA, 21 nt, Artificial Sequence
  CXCR4 targeting guide RNA
cagaugaauguccacuucgcu

SEQ ID NO: 886 - RNA, 21 nt, Artificial Sequence
  CXCR4 targeting guide RNA
ccaaaggaaagcgaaguggac

SEQ ID NO: 887 - RNA, 21 nt, Artificial Sequence
  CXCR4 targeting guide RNA
ccacuucgcuuuccuuuggag

SEQ ID NO: 888 - RNA, 21 nt, Artificial Sequence
  CXCR4 targeting guide RNA
ccucuccaaaggaaagcgaag

SEQ ID NO: 889 - RNA, 21 nt, Artificial Sequence
  CXCR4 targeting guide RNA
cgaaguggacauucaucuguu

SEQ ID NO: 890 - RNA, 21 nt, Artificial Sequence
  CXCR4 targeting guide RNA
cuccaaaggaaagcgaagugg

SEQ ID NO: 891 - RNA, 21 nt, Artificial Sequence
  CXCR4 targeting guide RNA
cucuccaaaggaaagcgaagu

SEQ ID NO: 892 - RNA, 21 nt, Artificial Sequence
  CXCR4 targeting guide RNA
cuucgcuuuccuuuggagagg

SEQ ID NO: 893 - RNA, 21 nt, Artificial Sequence
  CXCR4 targeting guide RNA
gaaacagaugaauguccacuu

SEQ ID NO: 894 - RNA, 21 nt, Artificial Sequence
  CXCR4 targeting guide RNA
gaaagcgaaguggacauucau

SEQ ID NO: 895 - RNA, 21 nt, Artificial Sequence
  CXCR4 targeting guide RNA
gaaguggacauucaucuguuu

SEQ ID NO: 896 - RNA, 21 nt, Artificial Sequence
  CXCR4 targeting guide RNA
gaauguccacuucgcuuuccu

SEQ ID NO: 897 - RNA, 21 nt, Artificial Sequence
  CXCR4 targeting guide RNA
gauccucuccaaaggaaagcg

SEQ ID NO: 898 - RNA, 21 nt, Artificial Sequence
  CXCR4 targeting guide RNA
gaugaauguccacuucgcuuu

SEQ ID NO: 899 - RNA, 21 nt, Artificial Sequence
  CXCR4 targeting guide RNA
gcgaaguggacauucaucugu

SEQ ID NO: 900 - RNA, 21 nt, Artificial Sequence
  CXCR4 targeting guide RNA
ggaaacagaugaauguccacu

SEQ ID NO: 901 - RNA, 21 nt, Artificial Sequence
  CXCR4 targeting guide RNA
ggaaagcgaaguggacauuca

SEQ ID NO: 902 - RNA, 21 nt, Artificial Sequence
  CXCR4 targeting guide RNA
guccacuucgcuuuccuuugg

SEQ ID NO: 903 - RNA, 21 nt, Artificial Sequence
  CXCR4 targeting guide RNA
guggaaacagaugaaugucca

SEQ ID NO: 904 - RNA, 21 nt, Artificial Sequence
  CXCR4 targeting guide RNA
uccaaaggaaagcgaagugga

SEQ ID NO: 905 - RNA, 21 nt, Artificial Sequence
  CXCR4 targeting guide RNA
uccacuucgcuuuccuuugga

SEQ ID NO: 906 - RNA, 21 nt, Artificial Sequence
  CXCR4 targeting guide RNA
uccucuccaaaggaaagcgaa

SEQ ID NO: 907 - RNA, 21 nt, Artificial Sequence
  CXCR4 targeting guide RNA
ucuccaaaggaaagcgaagug

SEQ ID NO: 908 - RNA, 21 nt, Artificial Sequence
  CXCR4 targeting guide RNA
ugaauguccacuucgcuuucc

SEQ ID NO: 909 - RNA, 21 nt, Artificial Sequence
  CXCR4 targeting guide RNA
uggaaacagaugaauguccac

SEQ ID NO: 910 - RNA, 21 nt, Artificial Sequence
  CXCR4 targeting guide RNA
uguccacuucgcuuuccuuug

SEQ ID NO: 911 - RNA, 21 nt, Artificial Sequence
  CXCR4 targeting guide RNA
uucgcuuuccuuuggagagga

SEQ ID NO: 912 - RNA, 22 nt, Artificial Sequence
  CXCR4 targeting guide RNA
aaacagaugaauguccacuucg

SEQ ID NO: 913 - RNA, 22 nt, Artificial Sequence
  CXCR4 targeting guide RNA
aaagcgaaguggacauucaucu

SEQ ID NO: 914 - RNA, 22 nt, Artificial Sequence
  CXCR4 targeting guide RNA
aaaggaaagcgaaguggacauu

SEQ ID NO: 915 - RNA, 22 nt, Artificial Sequence
  CXCR4 targeting guide RNA
aacagaugaauguccacuucgc

SEQ ID NO: 916 - RNA, 22 nt, Artificial Sequence
  CXCR4 targeting guide RNA
aagauccucuccaaaggaaagc

SEQ ID NO: 917 - RNA, 22 nt, Artificial Sequence
  CXCR4 targeting guide RNA
aagcgaaguggacauucaucug

SEQ ID NO: 918 - RNA, 22 nt, Artificial Sequence
  CXCR4 targeting guide RNA
aaggaaagcgaaguggacauuc

SEQ ID NO: 919 - RNA, 22 nt, Artificial Sequence
  CXCR4 targeting guide RNA
aaguggacauucaucuguuucc

SEQ ID NO: 920 - RNA, 22 nt, Artificial Sequence
  CXCR4 targeting guide RNA
aauguccacuucgcuuuccuuu

SEQ ID NO: 921 - RNA, 22 nt, Artificial Sequence
  CXCR4 targeting guide RNA
acagaugaauguccacuucgcu

SEQ ID NO: 922 - RNA, 22 nt, Artificial Sequence
  CXCR4 targeting guide RNA
acuucgcuuuccuuuggagagg

SEQ ID NO: 923 - RNA, 22 nt, Artificial Sequence
  CXCR4 targeting guide RNA
agauccucuccaaaggaaagcg

SEQ ID NO: 924 - RNA, 22 nt, Artificial Sequence
  CXCR4 targeting guide RNA
agaugaauguccacuucgcuuu

SEQ ID NO: 925 - RNA, 22 nt, Artificial Sequence
  CXCR4 targeting guide RNA
agcgaaguggacauucaucugu

SEQ ID NO: 926 - RNA, 22 nt, Artificial Sequence
  CXCR4 targeting guide RNA
aggaaagcgaaguggacauuca

SEQ ID NO: 927 - RNA, 22 nt, Artificial Sequence
  CXCR4 targeting guide RNA
aguggaaacagaugaaugucca

SEQ ID NO: 928 - RNA, 22 nt, Artificial Sequence
  CXCR4 targeting guide RNA
auccucuccaaaggaaagcgaa

SEQ ID NO: 929 - RNA, 22 nt, Artificial Sequence
  CXCR4 targeting guide RNA
augaauguccacuucgcuuucc

SEQ ID NO: 930 - RNA, 22 nt, Artificial Sequence
  CXCR4 targeting guide RNA
auguccacuucgcuuuccuuug

SEQ ID NO: 931 - RNA, 22 nt, Artificial Sequence
  CXCR4 targeting guide RNA
caaaggaaagcgaaguggacau

SEQ ID NO: 932 - RNA, 22 nt, Artificial Sequence
  CXCR4 targeting guide RNA
caagauccucuccaaaggaaag

SEQ ID NO: 933 - RNA, 22 nt, Artificial Sequence
  CXCR4 targeting guide RNA
cacuucgcuuuccuuuggagag

SEQ ID NO: 934 - RNA, 22 nt, Artificial Sequence
  CXCR4 targeting guide RNA
cagaugaauguccacuucgcuu

SEQ ID NO: 935 - RNA, 22 nt, Artificial Sequence
  CXCR4 targeting guide RNA
caguggaaacagaugaaugucc

SEQ ID NO: 936 - RNA, 22 nt, Artificial Sequence
  CXCR4 targeting guide RNA
ccaaaggaaagcgaaguggaca

SEQ ID NO: 937 - RNA, 22 nt, Artificial Sequence
  CXCR4 targeting guide RNA
ccacuucgcuuuccuuuggaga

SEQ ID NO: 938 - RNA, 22 nt, Artificial Sequence
  CXCR4 targeting guide RNA
ccucuccaaaggaaagcgaagu

SEQ ID NO: 939 - RNA, 22 nt, Artificial Sequence
  CXCR4 targeting guide RNA
cgaaguggacauucaucuguuu

SEQ ID NO: 940 - RNA, 22 nt, Artificial Sequence
  CXCR4 targeting guide RNA
cuccaaaggaaagcgaagugga

SEQ ID NO: 941 - RNA, 22 nt, Artificial Sequence
  CXCR4 targeting guide RNA
cucuccaaaggaaagcgaagug

SEQ ID NO: 942 - RNA, 22 nt, Artificial Sequence
  CXCR4 targeting guide RNA
cuucgcuuuccuuuggagagga

SEQ ID NO: 943 - RNA, 22 nt, Artificial Sequence
  CXCR4 targeting guide RNA
gaaacagaugaauguccacuuc

SEQ ID NO: 944 - RNA, 22 nt, Artificial Sequence
  CXCR4 targeting guide RNA
gaaagcgaaguggacauucauc

SEQ ID NO: 945 - RNA, 22 nt, Artificial Sequence
  CXCR4 targeting guide RNA
gaaguggacauucaucuguuuc

SEQ ID NO: 946 - RNA, 22 nt, Artificial Sequence
  CXCR4 targeting guide RNA
gaauguccacuucgcuuuccuu

SEQ ID NO: 947 - RNA, 22 nt, Artificial Sequence
  CXCR4 targeting guide RNA
gaugaauguccacuucgcuuuc

SEQ ID NO: 948 - RNA, 22 nt, Artificial Sequence
  CXCR4 targeting guide RNA
gcgaaguggacauucaucuguu

SEQ ID NO: 949 - RNA, 22 nt, Artificial Sequence
  CXCR4 targeting guide RNA
ggaaacagaugaauguccacuu

SEQ ID NO: 950 - RNA, 22 nt, Artificial Sequence
  CXCR4 targeting guide RNA
ggaaagcgaaguggacauucau

SEQ ID NO: 951 - RNA, 22 nt, Artificial Sequence
  CXCR4 targeting guide RNA
guccacuucgcuuuccuuugga

SEQ ID NO: 952 - RNA, 22 nt, Artificial Sequence
  CXCR4 targeting guide RNA
guggaaacagaugaauguccac

SEQ ID NO: 953 - RNA, 22 nt, Artificial Sequence
  CXCR4 targeting guide RNA
uccaaaggaaagcgaaguggac

SEQ ID NO: 954 - RNA, 22 nt, Artificial Sequence
  CXCR4 targeting guide RNA
uccacuucgcuuuccuuuggag

SEQ ID NO: 955 - RNA, 22 nt, Artificial Sequence
  CXCR4 targeting guide RNA
uccucuccaaaggaaagcgaag

SEQ ID NO: 956 - RNA, 22 nt, Artificial Sequence
  CXCR4 targeting guide RNA
ucuccaaaggaaagcgaagugg

SEQ ID NO: 957 - RNA, 22 nt, Artificial Sequence
  CXCR4 targeting guide RNA
ugaauguccacuucgcuuuccu

SEQ ID NO: 958 - RNA, 22 nt, Artificial Sequence
  CXCR4 targeting guide RNA
uggaaacagaugaauguccacu

SEQ ID NO: 959 - RNA, 22 nt, Artificial Sequence
  CXCR4 targeting guide RNA
uguccacuucgcuuuccuuugg

SEQ ID NO: 960 - RNA, 22 nt, Artificial Sequence
  CXCR4 targeting guide RNA
uucgcuuuccuuuggagaggau

SEQ ID NO: 961 - RNA, 20 nt, Artificial Sequence
  CXCR4 targeting guide RNA
aaacagaugaauguccaccu

SEQ ID NO: 962 - RNA, 20 nt, Artificial Sequence
  CXCR4 targeting guide RNA
aaaggaaagugagguggaca

SEQ ID NO: 963 - RNA, 20 nt, Artificial Sequence
  CXCR4 targeting guide RNA
aaagugagguggacauucau

SEQ ID NO: 964 - RNA, 20 nt, Artificial Sequence
  CXCR4 targeting guide RNA
aacagaugaauguccaccuc

SEQ ID NO: 965 - RNA, 20 nt, Artificial Sequence
  CXCR4 targeting guide RNA
aagauccucuccaaaggaaa

SEQ ID NO: 966 - RNA, 20 nt, Artificial Sequence
  CXCR4 targeting guide RNA
aaggaaagugagguggacau

SEQ ID NO: 967 - RNA, 20 nt, Artificial Sequence
  CXCR4 targeting guide RNA
aagugagguggacauucauc

SEQ ID NO: 968 - RNA, 20 nt, Artificial Sequence
  CXCR4 targeting guide RNA
aauguccaccucacuuuccu

SEQ ID NO: 969 - RNA, 20 nt, Artificial Sequence
  CXCR4 targeting guide RNA
acagaugaauguccaccuca

SEQ ID NO: 970 - RNA, 20 nt, Artificial Sequence
  CXCR4 targeting guide RNA
accucacuuuccuuuggaga

SEQ ID NO: 971 - RNA, 20 nt, Artificial Sequence
  CXCR4 targeting guide RNA
acuuuccuuuggagaggauc

SEQ ID NO: 972 - RNA, 20 nt, Artificial Sequence
  CXCR4 targeting guide RNA
agaugaauguccaccucacu

SEQ ID NO: 973 - RNA, 20 nt, Artificial Sequence
  CXCR4 targeting guide RNA
aggaaagugagguggacauu

SEQ ID NO: 974 - RNA, 20 nt, Artificial Sequence
  CXCR4 targeting guide RNA
agugagguggacauucaucu

SEQ ID NO: 975 - RNA, 20 nt, Artificial Sequence
  CXCR4 targeting guide RNA
auccucuccaaaggaaagug

SEQ ID NO: 976 - RNA, 20 nt, Artificial Sequence
  CXCR4 targeting guide RNA
augaauguccaccucacuuu

SEQ ID NO: 977 - RNA, 20 nt, Artificial Sequence
  CXCR4 targeting guide RNA
auguccaccucacuuuccuu

SEQ ID NO: 978 - RNA, 20 nt, Artificial Sequence
  CXCR4 targeting guide RNA
caaaggaaagugagguggac

SEQ ID NO: 979 - RNA, 20 nt, Artificial Sequence
  CXCR4 targeting guide RNA
caagauccucuccaaaggaa

SEQ ID NO: 980 - RNA, 20 nt, Artificial Sequence
  CXCR4 targeting guide RNA
caccucacuuuccuuuggag

SEQ ID NO: 981 - RNA, 20 nt, Artificial Sequence
  CXCR4 targeting guide RNA
cacuuuccuuuggagaggau

SEQ ID NO: 982 - RNA, 20 nt, Artificial Sequence
  CXCR4 targeting guide RNA
cagaugaauguccaccucac

SEQ ID NO: 983 - RNA, 20 nt, Artificial Sequence
  CXCR4 targeting guide RNA
ccaaaggaaagugaggugga

SEQ ID NO: 984 - RNA, 20 nt, Artificial Sequence
  CXCR4 targeting guide RNA
ccaccucacuuuccuuugga

SEQ ID NO: 985 - RNA, 20 nt, Artificial Sequence
  CXCR4 targeting guide RNA
ccucacuuuccuuuggagag

SEQ ID NO: 986 - RNA, 20 nt, Artificial Sequence
  CXCR4 targeting guide RNA
ccucuccaaaggaaagugag

SEQ ID NO: 987 - RNA, 20 nt, Artificial Sequence
  CXCR4 targeting guide RNA
cucacuuuccuuuggagagg

SEQ ID NO: 988 - RNA, 20 nt, Artificial Sequence
  CXCR4 targeting guide RNA
cuccaaaggaaagugaggug

SEQ ID NO: 989 - RNA, 20 nt, Artificial Sequence
  CXCR4 targeting guide RNA
cucuccaaaggaaagugagg

SEQ ID NO: 990 - RNA, 20 nt, Artificial Sequence
  CXCR4 targeting guide RNA
gaaacagaugaauguccacc

SEQ ID NO: 991 - RNA, 20 nt, Artificial Sequence
  CXCR4 targeting guide RNA
gaaagugagguggacauuca

SEQ ID NO: 992 - RNA, 20 nt, Artificial Sequence
  CXCR4 targeting guide RNA
gaauguccaccucacuuucc

SEQ ID NO: 993 - RNA, 20 nt, Artificial Sequence
  CXCR4 targeting guide RNA
gauccucuccaaaggaaagu

SEQ ID NO: 994 - RNA, 20 nt, Artificial Sequence
  CXCR4 targeting guide RNA
gaugaauguccaccucacuu

SEQ ID NO: 995 - RNA, 20 nt, Artificial Sequence
  CXCR4 targeting guide RNA
ggaaagugagguggacauuc

SEQ ID NO: 996 - RNA, 20 nt, Artificial Sequence
  CXCR4 targeting guide RNA
guccaccucacuuuccuuug

SEQ ID NO: 997 - RNA, 20 nt, Artificial Sequence
  CXCR4 targeting guide RNA
gugagguggacauucaucug

SEQ ID NO: 998 - RNA, 20 nt, Artificial Sequence
  CXCR4 targeting guide RNA
ucaagauccucuccaaagga

SEQ ID NO: 999 - RNA, 20 nt, Artificial Sequence
  CXCR4 targeting guide RNA
ucacuuuccuuuggagagga

SEQ ID NO: 1000 - RNA, 20 nt, Artificial Sequence
  CXCR4 targeting guide RNA
uccaaaggaaagugaggugg

SEQ ID NO: 1001 - RNA, 20 nt, Artificial Sequence
  CXCR4 targeting guide RNA
uccaccucacuuuccuuugg

SEQ ID NO: 1002 - RNA, 20 nt, Artificial Sequence
  CXCR4 targeting guide RNA
uccucuccaaaggaaaguga

SEQ ID NO: 1003 - RNA, 20 nt, Artificial Sequence
  CXCR4 targeting guide RNA
ucuccaaaggaaagugaggu

SEQ ID NO: 1004 - RNA, 20 nt, Artificial Sequence
  CXCR4 targeting guide RNA
ugaauguccaccucacuuuc

SEQ ID NO: 1005 - RNA, 20 nt, Artificial Sequence
  CXCR4 targeting guide RNA
uguccaccucacuuuccuuu

SEQ ID NO: 1006 - RNA, 21 nt, Artificial Sequence
  CXCR4 targeting guide RNA
aaacagaugaauguccaccuc

SEQ ID NO: 1007 - RNA, 21 nt, Artificial Sequence
  CXCR4 targeting guide RNA
aaaggaaagugagguggacau

SEQ ID NO: 1008 - RNA, 21 nt, Artificial Sequence
  CXCR4 targeting guide RNA
aaagugagguggacauucauc

SEQ ID NO: 1009 - RNA, 21 nt, Artificial Sequence
  CXCR4 targeting guide RNA
aacagaugaauguccaccuca

SEQ ID NO: 1010 - RNA, 21 nt, Artificial Sequence
  CXCR4 targeting guide RNA
aaggaaagugagguggacauu

SEQ ID NO: 1011 - RNA, 21 nt, Artificial Sequence
  CXCR4 targeting guide RNA
aagugagguggacauucaucu

SEQ ID NO: 1012 - RNA, 21 nt, Artificial Sequence
  CXCR4 targeting guide RNA
aauguccaccucacuuuccuu

SEQ ID NO: 1013 - RNA, 21 nt, Artificial Sequence
  CXCR4 targeting guide RNA
acagaugaauguccaccucac

SEQ ID NO: 1014 - RNA, 21 nt, Artificial Sequence
  CXCR4 targeting guide RNA
accucacuuuccuuuggagag

SEQ ID NO: 1015 - RNA, 21 nt, Artificial Sequence
  CXCR4 targeting guide RNA
acuuuccuuuggagaggaucu

SEQ ID NO: 1016 - RNA, 21 nt, Artificial Sequence
  CXCR4 targeting guide RNA
agauccucuccaaaggaaagu

SEQ ID NO: 1017 - RNA, 21 nt, Artificial Sequence
  CXCR4 targeting guide RNA
agaugaauguccaccucacuu

SEQ ID NO: 1018 - RNA, 21 nt, Artificial Sequence
  CXCR4 targeting guide RNA
aggaaagugagguggacauuc

SEQ ID NO: 1019 - RNA, 21 nt, Artificial Sequence
  CXCR4 targeting guide RNA
agugagguggacauucaucug

SEQ ID NO: 1020 - RNA, 21 nt, Artificial Sequence
  CXCR4 targeting guide RNA
auccucuccaaaggaaaguga

SEQ ID NO: 1021 - RNA, 21 nt, Artificial Sequence
  CXCR4 targeting guide RNA
augaauguccaccucacuuuc

SEQ ID NO: 1022 - RNA, 21 nt, Artificial Sequence
  CXCR4 targeting guide RNA
auguccaccucacuuuccuuu

SEQ ID NO: 1023 - RNA, 21 nt, Artificial Sequence
  CXCR4 targeting guide RNA
caaaggaaagugagguggaca

SEQ ID NO: 1024 - RNA, 21 nt, Artificial Sequence
  CXCR4 targeting guide RNA
caagauccucuccaaaggaaa

SEQ ID NO: 1025 - RNA, 21 nt, Artificial Sequence
  CXCR4 targeting guide RNA
caccucacuuuccuuuggaga

SEQ ID NO: 1026 - RNA, 21 nt, Artificial Sequence
  CXCR4 targeting guide RNA
cacuuuccuuuggagaggauc

SEQ ID NO: 1027 - RNA, 21 nt, Artificial Sequence
  CXCR4 targeting guide RNA
cagaugaauguccaccucacu

SEQ ID NO: 1028 - RNA, 21 nt, Artificial Sequence
  CXCR4 targeting guide RNA
ccaaaggaaagugagguggac

SEQ ID NO: 1029 - RNA, 21 nt, Artificial Sequence
  CXCR4 targeting guide RNA
ccaccucacuuuccuuuggag

SEQ ID NO: 1030 - RNA, 21 nt, Artificial Sequence
  CXCR4 targeting guide RNA
ccucacuuuccuuuggagagg

SEQ ID NO: 1031 - RNA, 21 nt, Artificial Sequence
  CXCR4 targeting guide RNA
ccucuccaaaggaaagugagg

SEQ ID NO: 1032 - RNA, 21 nt, Artificial Sequence
  CXCR4 targeting guide RNA
cucaagauccucuccaaagga

SEQ ID NO: 1033 - RNA, 21 nt, Artificial Sequence
  CXCR4 targeting guide RNA
cucacuuuccuuuggagagga

SEQ ID NO: 1034 - RNA, 21 nt, Artificial Sequence
  CXCR4 targeting guide RNA
cuccaaaggaaagugaggugg

SEQ ID NO: 1035 - RNA, 21 nt, Artificial Sequence
  CXCR4 targeting guide RNA
cucuccaaaggaaagugaggu

SEQ ID NO: 1036 - RNA, 21 nt, Artificial Sequence
  CXCR4 targeting guide RNA
gaaacagaugaauguccaccu

SEQ ID NO: 1037 - RNA, 21 nt, Artificial Sequence
  CXCR4 targeting guide RNA
gaaagugagguggacauucau

SEQ ID NO: 1038 - RNA, 21 nt, Artificial Sequence
  CXCR4 targeting guide RNA
gaauguccaccucacuuuccu

SEQ ID NO: 1039 - RNA, 21 nt, Artificial Sequence
  CXCR4 targeting guide RNA
gauccucuccaaaggaaagug

SEQ ID NO: 1040 - RNA, 21 nt, Artificial Sequence
  CXCR4 targeting guide RNA
gaugaauguccaccucacuuu

SEQ ID NO: 1041 - RNA, 21 nt, Artificial Sequence
  CXCR4 targeting guide RNA
ggaaacagaugaauguccacc

SEQ ID NO: 1042 - RNA, 21 nt, Artificial Sequence
  CXCR4 targeting guide RNA
ggaaagugagguggacauuca

SEQ ID NO: 1043 - RNA, 21 nt, Artificial Sequence
  CXCR4 targeting guide RNA
guccaccucacuuuccuuugg

SEQ ID NO: 1044 - RNA, 21 nt, Artificial Sequence
  CXCR4 targeting guide RNA
gugagguggacauucaucugu

SEQ ID NO: 1045 - RNA, 21 nt, Artificial Sequence
  CXCR4 targeting guide RNA
ucaagauccucuccaaaggaa

SEQ ID NO: 1046 - RNA, 21 nt, Artificial Sequence
  CXCR4 targeting guide RNA
ucacuuuccuuuggagaggau

SEQ ID NO: 1047 - RNA, 21 nt, Artificial Sequence
  CXCR4 targeting guide RNA
uccaaaggaaagugaggugga

SEQ ID NO: 1048 - RNA, 21 nt, Artificial Sequence
  CXCR4 targeting guide RNA
uccaccucacuuuccuuugga

SEQ ID NO: 1049 - RNA, 21 nt, Artificial Sequence
  CXCR4 targeting guide RNA
uccucuccaaaggaaagugag

SEQ ID NO: 1050 - RNA, 21 nt, Artificial Sequence
  CXCR4 targeting guide RNA
ucuccaaaggaaagugaggug

SEQ ID NO: 1051 - RNA, 21 nt, Artificial Sequence
  CXCR4 targeting guide RNA
ugaauguccaccucacuuucc

SEQ ID NO: 1052 - RNA, 21 nt, Artificial Sequence
  CXCR4 targeting guide RNA
uguccaccucacuuuccuuug

SEQ ID NO: 1053 - RNA, 22 nt, Artificial Sequence
  CXCR4 targeting guide RNA
aaacagaugaauguccaccuca

SEQ ID NO: 1054 - RNA, 22 nt, Artificial Sequence
  CXCR4 targeting guide RNA
aaaggaaagugagguggacauu

SEQ ID NO: 1055 - RNA, 22 nt, Artificial Sequence
  CXCR4 targeting guide RNA
aaagugagguggacauucaucu

SEQ ID NO: 1056 - RNA, 22 nt, Artificial Sequence
  CXCR4 targeting guide RNA
aacagaugaauguccaccucac

SEQ ID NO: 1057 - RNA, 22 nt, Artificial Sequence
  CXCR4 targeting guide RNA
aagauccucuccaaaggaaagu

SEQ ID NO: 1058 - RNA, 22 nt, Artificial Sequence
  CXCR4 targeting guide RNA
aaggaaagugagguggacauuc

SEQ ID NO: 1059 - RNA, 22 nt, Artificial Sequence
  CXCR4 targeting guide RNA
aagugagguggacauucaucug

SEQ ID NO: 1060 - RNA, 22 nt, Artificial Sequence
  CXCR4 targeting guide RNA
aauguccaccucacuuuccuuu

SEQ ID NO: 1061 - RNA, 22 nt, Artificial Sequence
  CXCR4 targeting guide RNA
acagaugaauguccaccucacu

SEQ ID NO: 1062 - RNA, 22 nt, Artificial Sequence
  CXCR4 targeting guide RNA
accucacuuuccuuuggagagg

SEQ ID NO: 1063 - RNA, 22 nt, Artificial Sequence
  CXCR4 targeting guide RNA
acuuuccuuuggagaggaucuu

SEQ ID NO: 1064 - RNA, 22 nt, Artificial Sequence
  CXCR4 targeting guide RNA
agauccucuccaaaggaaagug

SEQ ID NO: 1065 - RNA, 22 nt, Artificial Sequence
  CXCR4 targeting guide RNA
agaugaauguccaccucacuuu

SEQ ID NO: 1066 - RNA, 22 nt, Artificial Sequence
  CXCR4 targeting guide RNA
aggaaagugagguggacauuca

SEQ ID NO: 1067 - RNA, 22 nt, Artificial Sequence
  CXCR4 targeting guide RNA
agugagguggacauucaucugu

SEQ ID NO: 1068 - RNA, 22 nt, Artificial Sequence
  CXCR4 targeting guide RNA
auccucuccaaaggaaagugag

SEQ ID NO: 1069 - RNA, 22 nt, Artificial Sequence
  CXCR4 targeting guide RNA
augaauguccaccucacuuucc

SEQ ID NO: 1070 - RNA, 22 nt, Artificial Sequence
  CXCR4 targeting guide RNA
auguccaccucacuuuccuuug

SEQ ID NO: 1071 - RNA, 22 nt, Artificial Sequence
  CXCR4 targeting guide RNA
caaaggaaagugagguggacau

SEQ ID NO: 1072 - RNA, 22 nt, Artificial Sequence
  CXCR4 targeting guide RNA
caccucacuuuccuuuggagag

SEQ ID NO: 1073 - RNA, 22 nt, Artificial Sequence
  CXCR4 targeting guide RNA
cacuuuccuuuggagaggaucu

SEQ ID NO: 1074 - RNA, 22 nt, Artificial Sequence
  CXCR4 targeting guide RNA
cagaugaauguccaccucacuu

SEQ ID NO: 1075 - RNA, 22 nt, Artificial Sequence
  CXCR4 targeting guide RNA
ccaaaggaaagugagguggaca

SEQ ID NO: 1076 - RNA, 22 nt, Artificial Sequence
  CXCR4 targeting guide RNA
ccaccucacuuuccuuuggaga

SEQ ID NO: 1077 - RNA, 22 nt, Artificial Sequence
  CXCR4 targeting guide RNA
ccucaagauccucuccaaagga

SEQ ID NO: 1078 - RNA, 22 nt, Artificial Sequence
  CXCR4 targeting guide RNA
ccucacuuuccuuuggagagga

SEQ ID NO: 1079 - RNA, 22 nt, Artificial Sequence
  CXCR4 targeting guide RNA
ccucuccaaaggaaagugaggu

SEQ ID NO: 1080 - RNA, 22 nt, Artificial Sequence
  CXCR4 targeting guide RNA
cucaagauccucuccaaaggaa

SEQ ID NO: 1081 - RNA, 22 nt, Artificial Sequence
  CXCR4 targeting guide RNA
cucacuuuccuuuggagaggau

SEQ ID NO: 1082 - RNA, 22 nt, Artificial Sequence
  CXCR4 targeting guide RNA
cuccaaaggaaagugaggugga

SEQ ID NO: 1083 - RNA, 22 nt, Artificial Sequence
  CXCR4 targeting guide RNA
cucuccaaaggaaagugaggug

SEQ ID NO: 1084 - RNA, 22 nt, Artificial Sequence
  CXCR4 targeting guide RNA
gaaacagaugaauguccaccuc

SEQ ID NO: 1085 - RNA, 22 nt, Artificial Sequence
  CXCR4 targeting guide RNA
gaaagugagguggacauucauc

SEQ ID NO: 1086 - RNA, 22 nt, Artificial Sequence
  CXCR4 targeting guide RNA
gaauguccaccucacuuuccuu

SEQ ID NO: 1087 - RNA, 22 nt, Artificial Sequence
  CXCR4 targeting guide RNA
gauccucuccaaaggaaaguga

SEQ ID NO: 1088 - RNA, 22 nt, Artificial Sequence
  CXCR4 targeting guide RNA
gaugaauguccaccucacuuuc

SEQ ID NO: 1089 - RNA, 22 nt, Artificial Sequence
  CXCR4 targeting guide RNA
ggaaacagaugaauguccaccu

SEQ ID NO: 1090 - RNA, 22 nt, Artificial Sequence
  CXCR4 targeting guide RNA
ggaaagugagguggacauucau

SEQ ID NO: 1091 - RNA, 22 nt, Artificial Sequence
  CXCR4 targeting guide RNA
guccaccucacuuuccuuugga

SEQ ID NO: 1092 - RNA, 22 nt, Artificial Sequence
  CXCR4 targeting guide RNA
gugagguggacauucaucuguu

SEQ ID NO: 1093 - RNA, 22 nt, Artificial Sequence
  CXCR4 targeting guide RNA
ucaagauccucuccaaaggaaa

SEQ ID NO: 1094 - RNA, 22 nt, Artificial Sequence
  CXCR4 targeting guide RNA
ucacuuuccuuuggagaggauc

SEQ ID NO: 1095 - RNA, 22 nt, Artificial Sequence
  CXCR4 targeting guide RNA
uccaaaggaaagugagguggac

SEQ ID NO: 1096 - RNA, 22 nt, Artificial Sequence
  CXCR4 targeting guide RNA
uccaccucacuuuccuuuggag

SEQ ID NO: 1097 - RNA, 22 nt, Artificial Sequence
  CXCR4 targeting guide RNA
uccucuccaaaggaaagugagg

SEQ ID NO: 1098 - RNA, 22 nt, Artificial Sequence
  CXCR4 targeting guide RNA
ucuccaaaggaaagugaggugg

SEQ ID NO: 1099 - RNA, 22 nt, Artificial Sequence
  CXCR4 targeting guide RNA
ugaauguccaccucacuuuccu

SEQ ID NO: 1100 - RNA, 22 nt, Artificial Sequence
  CXCR4 targeting guide RNA
uggaaacagaugaauguccacc

SEQ ID NO: 1101 - RNA, 22 nt, Artificial Sequence
  CXCR4 targeting guide RNA
uguccaccucacuuuccuuugg

SEQ ID NO: 1102 - RNA, 20 nt, Artificial Sequence
  CXCR4 targeting guide RNA
aaaugaaagcgagguggaca

SEQ ID NO: 1103 - RNA, 20 nt, Artificial Sequence
  CXCR4 targeting guide RNA
aagauccucuccaaaugaaa

SEQ ID NO: 1104 - RNA, 20 nt, Artificial Sequence
  CXCR4 targeting guide RNA
aaugaaagcgagguggacau

SEQ ID NO: 1105 - RNA, 20 nt, Artificial Sequence
  CXCR4 targeting guide RNA
aauguccaccucgcuuucau

SEQ ID NO: 1106 - RNA, 20 nt, Artificial Sequence
  CXCR4 targeting guide RNA
accucgcuuucauuuggaga

SEQ ID NO: 1107 - RNA, 20 nt, Artificial Sequence
  CXCR4 targeting guide RNA
agauccucuccaaaugaaag

SEQ ID NO: 1108 - RNA, 20 nt, Artificial Sequence
  CXCR4 targeting guide RNA
agccucaagauccucuccaa

SEQ ID NO: 1109 - RNA, 20 nt, Artificial Sequence
  CXCR4 targeting guide RNA
auccucuccaaaugaaagcg

SEQ ID NO: 1110 - RNA, 20 nt, Artificial Sequence
  CXCR4 targeting guide RNA
augaaagcgagguggacauu

SEQ ID NO: 1111 - RNA, 20 nt, Artificial Sequence
  CXCR4 targeting guide RNA
augaauguccaccucgcuuu

SEQ ID NO: 1112 - RNA, 20 nt, Artificial Sequence
  CXCR4 targeting guide RNA
auguccaccucgcuuucauu

SEQ ID NO: 1113 - RNA, 20 nt, Artificial Sequence
  CXCR4 targeting guide RNA
auuuggagaggaucuugagg

SEQ ID NO: 1114 - RNA, 20 nt, Artificial Sequence
  CXCR4 targeting guide RNA
caaaugaaagcgagguggac

SEQ ID NO: 1115 - RNA, 20 nt, Artificial Sequence
  CXCR4 targeting guide RNA
caagauccucuccaaaugaa

SEQ ID NO: 1116 - RNA, 20 nt, Artificial Sequence
  CXCR4 targeting guide RNA
caccucgcuuucauuuggag

SEQ ID NO: 1117 - RNA, 20 nt, Artificial Sequence
  CXCR4 targeting guide RNA
cagccucaagauccucucca

SEQ ID NO: 1118 - RNA, 20 nt, Artificial Sequence
  CXCR4 targeting guide RNA
cauuuggagaggaucuugag

SEQ ID NO: 1119 - RNA, 20 nt, Artificial Sequence
  CXCR4 targeting guide RNA
ccaaaugaaagcgaggugga

SEQ ID NO: 1120 - RNA, 20 nt, Artificial Sequence
  CXCR4 targeting guide RNA
ccaccucgcuuucauuugga

SEQ ID NO: 1121 - RNA, 20 nt, Artificial Sequence
  CXCR4 targeting guide RNA
ccagccucaagauccucucc

SEQ ID NO: 1122 - RNA, 20 nt, Artificial Sequence
  CXCR4 targeting guide RNA
ccucaagauccucuccaaau

SEQ ID NO: 1123 - RNA, 20 nt, Artificial Sequence
  CXCR4 targeting guide RNA
ccucgcuuucauuuggagag

SEQ ID NO: 1124 - RNA, 20 nt, Artificial Sequence
  CXCR4 targeting guide RNA
ccucuccaaaugaaagcgag

SEQ ID NO: 1125 - RNA, 20 nt, Artificial Sequence
  CXCR4 targeting guide RNA
cgcuuucauuuggagaggau

SEQ ID NO: 1126 - RNA, 20 nt, Artificial Sequence
  CXCR4 targeting guide RNA
cucaagauccucuccaaaug

SEQ ID NO: 1127 - RNA, 20 nt, Artificial Sequence
  CXCR4 targeting guide RNA
cuccaaaugaaagcgaggug

SEQ ID NO: 1128 - RNA, 20 nt, Artificial Sequence
  CXCR4 targeting guide RNA
cucgcuuucauuuggagagg

SEQ ID NO: 1129 - RNA, 20 nt, Artificial Sequence
  CXCR4 targeting guide RNA
cucuccaaaugaaagcgagg

SEQ ID NO: 1130 - RNA, 20 nt, Artificial Sequence
  CXCR4 targeting guide RNA
cuuucauuuggagaggaucu

SEQ ID NO: 1131 - RNA, 20 nt, Artificial Sequence
  CXCR4 targeting guide RNA
gaauguccaccucgcuuuca

SEQ ID NO: 1132 - RNA, 20 nt, Artificial Sequence
  CXCR4 targeting guide RNA
gauccucuccaaaugaaagc

SEQ ID NO: 1133 - RNA, 20 nt, Artificial Sequence
  CXCR4 targeting guide RNA
gaugaauguccaccucgcuu

SEQ ID NO: 1134 - RNA, 20 nt, Artificial Sequence
  CXCR4 targeting guide RNA
gccucaagauccucuccaaa

SEQ ID NO: 1135 - RNA, 20 nt, Artificial Sequence
  CXCR4 targeting guide RNA
gcuuucauuuggagaggauc

SEQ ID NO: 1136 - RNA, 20 nt, Artificial Sequence
  CXCR4 targeting guide RNA
guccaccucgcuuucauuug

SEQ ID NO: 1137 - RNA, 20 nt, Artificial Sequence
  CXCR4 targeting guide RNA
ucaagauccucuccaaauga

SEQ ID NO: 1138 - RNA, 20 nt, Artificial Sequence
  CXCR4 targeting guide RNA
ucauuuggagaggaucuuga

SEQ ID NO: 1139 - RNA, 20 nt, Artificial Sequence
  CXCR4 targeting guide RNA
uccaaaugaaagcgaggugg

SEQ ID NO: 1140 - RNA, 20 nt, Artificial Sequence
  CXCR4 targeting guide RNA
uccaccucgcuuucauuugg

SEQ ID NO: 1141 - RNA, 20 nt, Artificial Sequence
  CXCR4 targeting guide RNA
uccucuccaaaugaaagcga

SEQ ID NO: 1142 - RNA, 20 nt, Artificial Sequence
  CXCR4 targeting guide RNA
ucgcuuucauuuggagagga

SEQ ID NO: 1143 - RNA, 20 nt, Artificial Sequence
  CXCR4 targeting guide RNA
ucuccaaaugaaagcgaggu

SEQ ID NO: 1144 - RNA, 20 nt, Artificial Sequence
  CXCR4 targeting guide RNA
ugaauguccaccucgcuuuc

SEQ ID NO: 1145 - RNA, 20 nt, Artificial Sequence
  CXCR4 targeting guide RNA
uguccaccucgcuuucauuu

SEQ ID NO: 1146 - RNA, 20 nt, Artificial Sequence
  CXCR4 targeting guide RNA
uucauuuggagaggaucuug

SEQ ID NO: 1147 - RNA, 20 nt, Artificial Sequence
  CXCR4 targeting guide RNA
uuucauuuggagaggaucuu

SEQ ID NO: 1148 - RNA, 21 nt, Artificial Sequence
  CXCR4 targeting guide RNA
aaaugaaagcgagguggacau

SEQ ID NO: 1149 - RNA, 21 nt, Artificial Sequence
  CXCR4 targeting guide RNA
aagauccucuccaaaugaaag

SEQ ID NO: 1150 - RNA, 21 nt, Artificial Sequence
  CXCR4 targeting guide RNA
aaugaaagcgagguggacauu

SEQ ID NO: 1151 - RNA, 21 nt, Artificial Sequence
  CXCR4 targeting guide RNA
aauguccaccucgcuuucauu

SEQ ID NO: 1152 - RNA, 21 nt, Artificial Sequence
  CXCR4 targeting guide RNA
accucgcuuucauuuggagag

SEQ ID NO: 1153 - RNA, 21 nt, Artificial Sequence
  CXCR4 targeting guide RNA
agauccucuccaaaugaaagc

SEQ ID NO: 1154 - RNA, 21 nt, Artificial Sequence
  CXCR4 targeting guide RNA
agaugaauguccaccucgcuu

SEQ ID NO: 1155 - RNA, 21 nt, Artificial Sequence
  CXCR4 targeting guide RNA
agccucaagauccucuccaaa

SEQ ID NO: 1156 - RNA, 21 nt, Artificial Sequence
  CXCR4 targeting guide RNA
auccucuccaaaugaaagcga

SEQ ID NO: 1157 - RNA, 21 nt, Artificial Sequence
  CXCR4 targeting guide RNA
augaaagcgagguggacauuc

SEQ ID NO: 1158 - RNA, 21 nt, Artificial Sequence
  CXCR4 targeting guide RNA
augaauguccaccucgcuuuc

SEQ ID NO: 1159 - RNA, 21 nt, Artificial Sequence
  CXCR4 targeting guide RNA
auguccaccucgcuuucauuu

SEQ ID NO: 1160 - RNA, 21 nt, Artificial Sequence
  CXCR4 targeting guide RNA
auuuggagaggaucuugaggc

SEQ ID NO: 1161 - RNA, 21 nt, Artificial Sequence
  CXCR4 targeting guide RNA
caaaugaaagcgagguggaca

SEQ ID NO: 1162 - RNA, 21 nt, Artificial Sequence
  CXCR4 targeting guide RNA
caagauccucuccaaaugaaa

SEQ ID NO: 1163 - RNA, 21 nt, Artificial Sequence
  CXCR4 targeting guide RNA
caccucgcuuucauuuggaga

SEQ ID NO: 1164 - RNA, 21 nt, Artificial Sequence
  CXCR4 targeting guide RNA
cagccucaagauccucuccaa

SEQ ID NO: 1165 - RNA, 21 nt, Artificial Sequence
  CXCR4 targeting guide RNA
cauuuggagaggaucuugagg

SEQ ID NO: 1166 - RNA, 21 nt, Artificial Sequence
  CXCR4 targeting guide RNA
ccaaaugaaagcgagguggac

SEQ ID NO: 1167 - RNA, 21 nt, Artificial Sequence
  CXCR4 targeting guide RNA
ccaccucgcuuucauuuggag

SEQ ID NO: 1168 - RNA, 21 nt, Artificial Sequence
  CXCR4 targeting guide RNA
ccagccucaagauccucucca

SEQ ID NO: 1169 - RNA, 21 nt, Artificial Sequence
  CXCR4 targeting guide RNA
ccucaagauccucuccaaaug

SEQ ID NO: 1170 - RNA, 21 nt, Artificial Sequence
  CXCR4 targeting guide RNA
ccucgcuuucauuuggagagg

SEQ ID NO: 1171 - RNA, 21 nt, Artificial Sequence
  CXCR4 targeting guide RNA
ccucuccaaaugaaagcgagg

SEQ ID NO: 1172 - RNA, 21 nt, Artificial Sequence
  CXCR4 targeting guide RNA
cgcuuucauuuggagaggauc

SEQ ID NO: 1173 - RNA, 21 nt, Artificial Sequence
  CXCR4 targeting guide RNA
cucaagauccucuccaaauga

SEQ ID NO: 1174 - RNA, 21 nt, Artificial Sequence
  CXCR4 targeting guide RNA
cuccaaaugaaagcgaggugg

SEQ ID NO: 1175 - RNA, 21 nt, Artificial Sequence
  CXCR4 targeting guide RNA
cucgcuuucauuuggagagga

SEQ ID NO: 1176 - RNA, 21 nt, Artificial Sequence
  CXCR4 targeting guide RNA
cucuccaaaugaaagcgaggu

SEQ ID NO: 1177 - RNA, 21 nt, Artificial Sequence
  CXCR4 targeting guide RNA
cuuucauuuggagaggaucuu

SEQ ID NO: 1178 - RNA, 21 nt, Artificial Sequence
  CXCR4 targeting guide RNA
gaauguccaccucgcuuucau

SEQ ID NO: 1179 - RNA, 21 nt, Artificial Sequence
  CXCR4 targeting guide RNA
gauccucuccaaaugaaagcg

SEQ ID NO: 1180 - RNA, 21 nt, Artificial Sequence
  CXCR4 targeting guide RNA
gaugaauguccaccucgcuuu

SEQ ID NO: 1181 - RNA, 21 nt, Artificial Sequence
  CXCR4 targeting guide RNA
gccucaagauccucuccaaau

SEQ ID NO: 1182 - RNA, 21 nt, Artificial Sequence
  CXCR4 targeting guide RNA
gcuuucauuuggagaggaucu

SEQ ID NO: 1183 - RNA, 21 nt, Artificial Sequence
  CXCR4 targeting guide RNA
guccaccucgcuuucauuugg

SEQ ID NO: 1184 - RNA, 21 nt, Artificial Sequence
  CXCR4 targeting guide RNA
ucaagauccucuccaaaugaa

SEQ ID NO: 1185 - RNA, 21 nt, Artificial Sequence
  CXCR4 targeting guide RNA
ucauuuggagaggaucuugag

SEQ ID NO: 1186 - RNA, 21 nt, Artificial Sequence
  CXCR4 targeting guide RNA
uccaaaugaaagcgaggugga

SEQ ID NO: 1187 - RNA, 21 nt, Artificial Sequence
  CXCR4 targeting guide RNA
uccaccucgcuuucauuugga

SEQ ID NO: 1188 - RNA, 21 nt, Artificial Sequence
  CXCR4 targeting guide RNA
uccagccucaagauccucucc

SEQ ID NO: 1189 - RNA, 21 nt, Artificial Sequence
  CXCR4 targeting guide RNA
uccucuccaaaugaaagcgag

SEQ ID NO: 1190 - RNA, 21 nt, Artificial Sequence
  CXCR4 targeting guide RNA
ucgcuuucauuuggagaggau

SEQ ID NO: 1191 - RNA, 21 nt, Artificial Sequence
  CXCR4 targeting guide RNA
ucuccaaaugaaagcgaggug

SEQ ID NO: 1192 - RNA, 21 nt, Artificial Sequence
  CXCR4 targeting guide RNA
ugaauguccaccucgcuuuca

SEQ ID NO: 1193 - RNA, 21 nt, Artificial Sequence
  CXCR4 targeting guide RNA
uguccaccucgcuuucauuug

SEQ ID NO: 1194 - RNA, 21 nt, Artificial Sequence
  CXCR4 targeting guide RNA
uucauuuggagaggaucuuga

SEQ ID NO: 1195 - RNA, 21 nt, Artificial Sequence
  CXCR4 targeting guide RNA
uuucauuuggagaggaucuug

SEQ ID NO: 1196 - RNA, 22 nt, Artificial Sequence
  CXCR4 targeting guide RNA
aaaugaaagcgagguggacauu

SEQ ID NO: 1197 - RNA, 22 nt, Artificial Sequence
  CXCR4 targeting guide RNA
aagauccucuccaaaugaaagc

SEQ ID NO: 1198 - RNA, 22 nt, Artificial Sequence
  CXCR4 targeting guide RNA
aaugaaagcgagguggacauuc

SEQ ID NO: 1199 - RNA, 22 nt, Artificial Sequence
  CXCR4 targeting guide RNA
aauguccaccucgcuuucauuu

SEQ ID NO: 1200 - RNA, 22 nt, Artificial Sequence
  CXCR4 targeting guide RNA
accucgcuuucauuuggagagg

SEQ ID NO: 1201 - RNA, 22 nt, Artificial Sequence
  CXCR4 targeting guide RNA
agauccucuccaaaugaaagcg

SEQ ID NO: 1202 - RNA, 22 nt, Artificial Sequence
  CXCR4 targeting guide RNA
agaugaauguccaccucgcuuu

SEQ ID NO: 1203 - RNA, 22 nt, Artificial Sequence
  CXCR4 targeting guide RNA
agccucaagauccucuccaaau

SEQ ID NO: 1204 - RNA, 22 nt, Artificial Sequence
  CXCR4 targeting guide RNA
auccucuccaaaugaaagcgag

SEQ ID NO: 1205 - RNA, 22 nt, Artificial Sequence
  CXCR4 targeting guide RNA
augaaagcgagguggacauuca

SEQ ID NO: 1206 - RNA, 22 nt, Artificial Sequence
  CXCR4 targeting guide RNA
augaauguccaccucgcuuuca

SEQ ID NO: 1207 - RNA, 22 nt, Artificial Sequence
  CXCR4 targeting guide RNA
auguccaccucgcuuucauuug

SEQ ID NO: 1208 - RNA, 22 nt, Artificial Sequence
  CXCR4 targeting guide RNA
auuuggagaggaucuugaggcu

SEQ ID NO: 1209 - RNA, 22 nt, Artificial Sequence
  CXCR4 targeting guide RNA
caaaugaaagcgagguggacau

SEQ ID NO: 1210 - RNA, 22 nt, Artificial Sequence
  CXCR4 targeting guide RNA
caagauccucuccaaaugaaag

SEQ ID NO: 1211 - RNA, 22 nt, Artificial Sequence
  CXCR4 targeting guide RNA
caccucgcuuucauuuggagag

SEQ ID NO: 1212 - RNA, 22 nt, Artificial Sequence
  CXCR4 targeting guide RNA
cagaugaauguccaccucgcuu

SEQ ID NO: 1213 - RNA, 22 nt, Artificial Sequence
  CXCR4 targeting guide RNA
cagccucaagauccucuccaaa

SEQ ID NO: 1214 - RNA, 22 nt, Artificial Sequence
  CXCR4 targeting guide RNA
cauuuggagaggaucuugaggc

SEQ ID NO: 1215 - RNA, 22 nt, Artificial Sequence
  CXCR4 targeting guide RNA
ccaaaugaaagcgagguggaca

SEQ ID NO: 1216 - RNA, 22 nt, Artificial Sequence
  CXCR4 targeting guide RNA
ccaccucgcuuucauuuggaga

SEQ ID NO: 1217 - RNA, 22 nt, Artificial Sequence
  CXCR4 targeting guide RNA
ccagccucaagauccucuccaa

SEQ ID NO: 1218 - RNA, 22 nt, Artificial Sequence
  CXCR4 targeting guide RNA
ccucaagauccucuccaaauga

SEQ ID NO: 1219 - RNA, 22 nt, Artificial Sequence
  CXCR4 targeting guide RNA
ccucgcuuucauuuggagagga

SEQ ID NO: 1220 - RNA, 22 nt, Artificial Sequence
  CXCR4 targeting guide RNA
ccucuccaaaugaaagcgaggu

SEQ ID NO: 1221 - RNA, 22 nt, Artificial Sequence
  CXCR4 targeting guide RNA
cgcuuucauuuggagaggaucu

SEQ ID NO: 1222 - RNA, 22 nt, Artificial Sequence
  CXCR4 targeting guide RNA
cucaagauccucuccaaaugaa

SEQ ID NO: 1223 - RNA, 22 nt, Artificial Sequence
  CXCR4 targeting guide RNA
cuccaaaugaaagcgaggugga

SEQ ID NO: 1224 - RNA, 22 nt, Artificial Sequence
  CXCR4 targeting guide RNA
cucgcuuucauuuggagaggau

SEQ ID NO: 1225 - RNA, 22 nt, Artificial Sequence
  CXCR4 targeting guide RNA
cucuccaaaugaaagcgaggug

SEQ ID NO: 1226 - RNA, 22 nt, Artificial Sequence
  CXCR4 targeting guide RNA
cuuucauuuggagaggaucuug

SEQ ID NO: 1227 - RNA, 22 nt, Artificial Sequence
  CXCR4 targeting guide RNA
gaauguccaccucgcuuucauu

SEQ ID NO: 1228 - RNA, 22 nt, Artificial Sequence
  CXCR4 targeting guide RNA
gauccucuccaaaugaaagcga

SEQ ID NO: 1229 - RNA, 22 nt, Artificial Sequence
  CXCR4 targeting guide RNA
gaugaauguccaccucgcuuuc

SEQ ID NO: 1230 - RNA, 22 nt, Artificial Sequence
  CXCR4 targeting guide RNA
gccucaagauccucuccaaaug

SEQ ID NO: 1231 - RNA, 22 nt, Artificial Sequence
  CXCR4 targeting guide RNA
gcuuucauuuggagaggaucuu

SEQ ID NO: 1232 - RNA, 22 nt, Artificial Sequence
  CXCR4 targeting guide RNA
guccaccucgcuuucauuugga

SEQ ID NO: 1233 - RNA, 22 nt, Artificial Sequence
  CXCR4 targeting guide RNA
guccagccucaagauccucucc

SEQ ID NO: 1234 - RNA, 22 nt, Artificial Sequence
  CXCR4 targeting guide RNA
ucaagauccucuccaaaugaaa

SEQ ID NO: 1235 - RNA, 22 nt, Artificial Sequence
  CXCR4 targeting guide RNA
ucauuuggagaggaucuugagg

SEQ ID NO: 1236 - RNA, 22 nt, Artificial Sequence
  CXCR4 targeting guide RNA
uccaaaugaaagcgagguggac

SEQ ID NO: 1237 - RNA, 22 nt, Artificial Sequence
  CXCR4 targeting guide RNA
uccaccucgcuuucauuuggag

SEQ ID NO: 1238 - RNA, 22 nt, Artificial Sequence
  CXCR4 targeting guide RNA
uccagccucaagauccucucca

SEQ ID NO: 1239 - RNA, 22 nt, Artificial Sequence
  CXCR4 targeting guide RNA
uccucuccaaaugaaagcgagg

SEQ ID NO: 1240 - RNA, 22 nt, Artificial Sequence
  CXCR4 targeting guide RNA
ucgcuuucauuuggagaggauc

SEQ ID NO: 1241 - RNA, 22 nt, Artificial Sequence
  CXCR4 targeting guide RNA
ucuccaaaugaaagcgaggugg

SEQ ID NO: 1242 - RNA, 22 nt, Artificial Sequence
  CXCR4 targeting guide RNA
ugaauguccaccucgcuuucau

SEQ ID NO: 1243 - RNA, 22 nt, Artificial Sequence
  CXCR4 targeting guide RNA
uguccaccucgcuuucauuugg

SEQ ID NO: 1244 - RNA, 22 nt, Artificial Sequence
  CXCR4 targeting guide RNA
uucauuuggagaggaucuugag

SEQ ID NO: 1245 - RNA, 22 nt, Artificial Sequence
  CXCR4 targeting guide RNA
uuucauuuggagaggaucuuga

SEQ ID NO: 1246 - RNA, 20 nt, Artificial Sequence
  CXCR4 targeting guide RNA
aaggauucgaugcugauccc

SEQ ID NO: 1247 - RNA, 20 nt, Artificial Sequence
  CXCR4 targeting guide RNA
aauccuucauccuccuggaa

SEQ ID NO: 1248 - RNA, 20 nt, Artificial Sequence
  CXCR4 targeting guide RNA
acauugggaucagcaucgaa

SEQ ID NO: 1249 - RNA, 20 nt, Artificial Sequence
  CXCR4 targeting guide RNA
acuacauugggaucagcauc

SEQ ID NO: 1250 - RNA, 20 nt, Artificial Sequence
  CXCR4 targeting guide RNA
agcaucgaauccuucauccu

SEQ ID NO: 1251 - RNA, 20 nt, Artificial Sequence
  CXCR4 targeting guide RNA
aggaggaugaaggauucgau

SEQ ID NO: 1252 - RNA, 20 nt, Artificial Sequence
  CXCR4 targeting guide RNA
aggaugaaggauucgaugcu

SEQ ID NO: 1253 - RNA, 20 nt, Artificial Sequence
  CXCR4 targeting guide RNA
aggauucgaugcugauccca

SEQ ID NO: 1254 - RNA, 20 nt, Artificial Sequence
  CXCR4 targeting guide RNA
aucagcaucgaauccuucau

SEQ ID NO: 1255 - RNA, 20 nt, Artificial Sequence
  CXCR4 targeting guide RNA
aucgaauccuucauccuccu

SEQ ID NO: 1256 - RNA, 20 nt, Artificial Sequence
  CXCR4 targeting guide RNA
augaaggauucgaugcugau

SEQ ID NO: 1257 - RNA, 20 nt, Artificial Sequence
  CXCR4 targeting guide RNA
auucgaugcugaucccaaug

SEQ ID NO: 1258 - RNA, 20 nt, Artificial Sequence
  CXCR4 targeting guide RNA
auugggaucagcaucgaauc

SEQ ID NO: 1259 - RNA, 20 nt, Artificial Sequence
  CXCR4 targeting guide RNA
auuuccaggaggaugaagga

SEQ ID NO: 1260 - RNA, 20 nt, Artificial Sequence
  CXCR4 targeting guide RNA
cagcaucgaauccuucaucc

SEQ ID NO: 1261 - RNA, 20 nt, Artificial Sequence
  CXCR4 targeting guide RNA
caggaggaugaaggauucga

SEQ ID NO: 1262 - RNA, 20 nt, Artificial Sequence
  CXCR4 targeting guide RNA
caucgaauccuucauccucc

SEQ ID NO: 1263 - RNA, 20 nt, Artificial Sequence
  CXCR4 targeting guide RNA
cauugggaucagcaucgaau

SEQ ID NO: 1264 - RNA, 20 nt, Artificial Sequence
  CXCR4 targeting guide RNA
ccaggaggaugaaggauucg

SEQ ID NO: 1265 - RNA, 20 nt, Artificial Sequence
  CXCR4 targeting guide RNA
cgaauccuucauccuccugg

SEQ ID NO: 1266 - RNA, 20 nt, Artificial Sequence
  CXCR4 targeting guide RNA
cuacauugggaucagcaucg

SEQ ID NO: 1267 - RNA, 20 nt, Artificial Sequence
  CXCR4 targeting guide RNA
gaaggauucgaugcugaucc

SEQ ID NO: 1268 - RNA, 20 nt, Artificial Sequence
  CXCR4 targeting guide RNA
gaauccuucauccuccugga

SEQ ID NO: 1269 - RNA, 20 nt, Artificial Sequence
  CXCR4 targeting guide RNA
gaggaugaaggauucgaugc

SEQ ID NO: 1270 - RNA, 20 nt, Artificial Sequence
  CXCR4 targeting guide RNA
gaucagcaucgaauccuuca

SEQ ID NO: 1271 - RNA, 20 nt, Artificial Sequence
  CXCR4 targeting guide RNA
gaugaaggauucgaugcuga

SEQ ID NO: 1272 - RNA, 20 nt, Artificial Sequence
  CXCR4 targeting guide RNA
gauucgaugcugaucccaau

SEQ ID NO: 1273 - RNA, 20 nt, Artificial Sequence
  CXCR4 targeting guide RNA
gauuuccaggaggaugaagg

SEQ ID NO: 1274 - RNA, 20 nt, Artificial Sequence
  CXCR4 targeting guide RNA
gcaucgaauccuucauccuc

SEQ ID NO: 1275 - RNA, 20 nt, Artificial Sequence
  CXCR4 targeting guide RNA
ggaggaugaaggauucgaug

SEQ ID NO: 1276 - RNA, 20 nt, Artificial Sequence
  CXCR4 targeting guide RNA
ggaucagcaucgaauccuuc

SEQ ID NO: 1277 - RNA, 20 nt, Artificial Sequence
  CXCR4 targeting guide RNA
ggaugaaggauucgaugcug

SEQ ID NO: 1278 - RNA, 20 nt, Artificial Sequence
  CXCR4 targeting guide RNA
ggauucgaugcugaucccaa

SEQ ID NO: 1279 - RNA, 20 nt, Artificial Sequence
  CXCR4 targeting guide RNA
gggaucagcaucgaauccuu

SEQ ID NO: 1280 - RNA, 20 nt, Artificial Sequence
  CXCR4 targeting guide RNA
uacauugggaucagcaucga

SEQ ID NO: 1281 - RNA, 20 nt, Artificial Sequence
  CXCR4 targeting guide RNA
uacuacauugggaucagcau

SEQ ID NO: 1282 - RNA, 20 nt, Artificial Sequence
  CXCR4 targeting guide RNA
ucagcaucgaauccuucauc

SEQ ID NO: 1283 - RNA, 20 nt, Artificial Sequence
  CXCR4 targeting guide RNA
uccaggaggaugaaggauuc

SEQ ID NO: 1284 - RNA, 20 nt, Artificial Sequence
  CXCR4 targeting guide RNA
ucgaauccuucauccuccug

SEQ ID NO: 1285 - RNA, 20 nt, Artificial Sequence
  CXCR4 targeting guide RNA
ugaaggauucgaugcugauc

SEQ ID NO: 1286 - RNA, 20 nt, Artificial Sequence
  CXCR4 targeting guide RNA
ugauuuccaggaggaugaag

SEQ ID NO: 1287 - RNA, 20 nt, Artificial Sequence
  CXCR4 targeting guide RNA
ugggaucagcaucgaauccu

SEQ ID NO: 1288 - RNA, 20 nt, Artificial Sequence
  CXCR4 targeting guide RNA
uuccaggaggaugaaggauu

SEQ ID NO: 1289 - RNA, 20 nt, Artificial Sequence
  CXCR4 targeting guide RNA
uucgaugcugaucccaaugu

SEQ ID NO: 1290 - RNA, 20 nt, Artificial Sequence
  CXCR4 targeting guide RNA
uugggaucagcaucgaaucc

SEQ ID NO: 1291 - RNA, 20 nt, Artificial Sequence
  CXCR4 targeting guide RNA
uuuccaggaggaugaaggau

SEQ ID NO: 1292 - RNA, 21 nt, Artificial Sequence
  CXCR4 targeting guide RNA
aaggauucgaugcugauccca

SEQ ID NO: 1293 - RNA, 21 nt, Artificial Sequence
  CXCR4 targeting guide RNA
aauccuucauccuccuggaaa

SEQ ID NO: 1294 - RNA, 21 nt, Artificial Sequence
  CXCR4 targeting guide RNA
acauugggaucagcaucgaau

SEQ ID NO: 1295 - RNA, 21 nt, Artificial Sequence
  CXCR4 targeting guide RNA
acuacauugggaucagcaucg

SEQ ID NO: 1296 - RNA, 21 nt, Artificial Sequence
  CXCR4 targeting guide RNA
agcaucgaauccuucauccuc

SEQ ID NO: 1297 - RNA, 21 nt, Artificial Sequence
  CXCR4 targeting guide RNA
aggaggaugaaggauucgaug

SEQ ID NO: 1298 - RNA, 21 nt, Artificial Sequence
  CXCR4 targeting guide RNA
aggaugaaggauucgaugcug

SEQ ID NO: 1299 - RNA, 21 nt, Artificial Sequence
  CXCR4 targeting guide RNA
aggauucgaugcugaucccaa

SEQ ID NO: 1300 - RNA, 21 nt, Artificial Sequence
  CXCR4 targeting guide RNA
aucagcaucgaauccuucauc

SEQ ID NO: 1301 - RNA, 21 nt, Artificial Sequence
  CXCR4 targeting guide RNA
aucgaauccuucauccuccug

SEQ ID NO: 1302 - RNA, 21 nt, Artificial Sequence
  CXCR4 targeting guide RNA
augaaggauucgaugcugauc

SEQ ID NO: 1303 - RNA, 21 nt, Artificial Sequence
  CXCR4 targeting guide RNA
augauuuccaggaggaugaag

SEQ ID NO: 1304 - RNA, 21 nt, Artificial Sequence
  CXCR4 targeting guide RNA
auucgaugcugaucccaaugu

SEQ ID NO: 1305 - RNA, 21 nt, Artificial Sequence
  CXCR4 targeting guide RNA
auugggaucagcaucgaaucc

SEQ ID NO: 1306 - RNA, 21 nt, Artificial Sequence
  CXCR4 targeting guide RNA
auuuccaggaggaugaaggau

SEQ ID NO: 1307 - RNA, 21 nt, Artificial Sequence
  CXCR4 targeting guide RNA
cagcaucgaauccuucauccu

SEQ ID NO: 1308 - RNA, 21 nt, Artificial Sequence
  CXCR4 targeting guide RNA
caggaggaugaaggauucgau

SEQ ID NO: 1309 - RNA, 21 nt, Artificial Sequence
  CXCR4 targeting guide RNA
caucgaauccuucauccuccu

SEQ ID NO: 1310 - RNA, 21 nt, Artificial Sequence
  CXCR4 targeting guide RNA
cauugggaucagcaucgaauc

SEQ ID NO: 1311 - RNA, 21 nt, Artificial Sequence
  CXCR4 targeting guide RNA
ccaggaggaugaaggauucga

SEQ ID NO: 1312 - RNA, 21 nt, Artificial Sequence
  CXCR4 targeting guide RNA
cgaauccuucauccuccugga

SEQ ID NO: 1313 - RNA, 21 nt, Artificial Sequence
  CXCR4 targeting guide RNA
cuacauugggaucagcaucga

SEQ ID NO: 1314 - RNA, 21 nt, Artificial Sequence
  CXCR4 targeting guide RNA
gaaggauucgaugcugauccc

SEQ ID NO: 1315 - RNA, 21 nt, Artificial Sequence
  CXCR4 targeting guide RNA
gaauccuucauccuccuggaa

SEQ ID NO: 1316 - RNA, 21 nt, Artificial Sequence
  CXCR4 targeting guide RNA
gaggaugaaggauucgaugcu

SEQ ID NO: 1317 - RNA, 21 nt, Artificial Sequence
  CXCR4 targeting guide RNA
gaucagcaucgaauccuucau

SEQ ID NO: 1318 - RNA, 21 nt, Artificial Sequence
  CXCR4 targeting guide RNA
gaugaaggauucgaugcugau

SEQ ID NO: 1319 - RNA, 21 nt, Artificial Sequence
  CXCR4 targeting guide RNA
gauucgaugcugaucccaaug

SEQ ID NO: 1320 - RNA, 21 nt, Artificial Sequence
  CXCR4 targeting guide RNA
gauuuccaggaggaugaagga

SEQ ID NO: 1321 - RNA, 21 nt, Artificial Sequence
  CXCR4 targeting guide RNA
gcaucgaauccuucauccucc

SEQ ID NO: 1322 - RNA, 21 nt, Artificial Sequence
  CXCR4 targeting guide RNA
ggaggaugaaggauucgaugc

SEQ ID NO: 1323 - RNA, 21 nt, Artificial Sequence
  CXCR4 targeting guide RNA
ggaucagcaucgaauccuuca

SEQ ID NO: 1324 - RNA, 21 nt, Artificial Sequence
  CXCR4 targeting guide RNA
ggaugaaggauucgaugcuga

SEQ ID NO: 1325 - RNA, 21 nt, Artificial Sequence
  CXCR4 targeting guide RNA
ggauucgaugcugaucccaau

SEQ ID NO: 1326 - RNA, 21 nt, Artificial Sequence
  CXCR4 targeting guide RNA
gggaucagcaucgaauccuuc

SEQ ID NO: 1327 - RNA, 21 nt, Artificial Sequence
  CXCR4 targeting guide RNA
uacauugggaucagcaucgaa

SEQ ID NO: 1328 - RNA, 21 nt, Artificial Sequence
  CXCR4 targeting guide RNA
uacuacauugggaucagcauc

SEQ ID NO: 1329 - RNA, 21 nt, Artificial Sequence
  CXCR4 targeting guide RNA
ucagcaucgaauccuucaucc

SEQ ID NO: 1330 - RNA, 21 nt, Artificial Sequence
  CXCR4 targeting guide RNA
uccaggaggaugaaggauucg

SEQ ID NO: 1331 - RNA, 21 nt, Artificial Sequence
  CXCR4 targeting guide RNA
ucgaauccuucauccuccugg

SEQ ID NO: 1332 - RNA, 21 nt, Artificial Sequence
  CXCR4 targeting guide RNA
ugaaggauucgaugcugaucc

SEQ ID NO: 1333 - RNA, 21 nt, Artificial Sequence
  CXCR4 targeting guide RNA
ugauuuccaggaggaugaagg

SEQ ID NO: 1334 - RNA, 21 nt, Artificial Sequence
  CXCR4 targeting guide RNA
ugggaucagcaucgaauccuu

SEQ ID NO: 1335 - RNA, 21 nt, Artificial Sequence
  CXCR4 targeting guide RNA
uuacuacauugggaucagcau

SEQ ID NO: 1336 - RNA, 21 nt, Artificial Sequence
  CXCR4 targeting guide RNA
uuccaggaggaugaaggauuc

SEQ ID NO: 1337 - RNA, 21 nt, Artificial Sequence
  CXCR4 targeting guide RNA
uucgaugcugaucccaaugua

SEQ ID NO: 1338 - RNA, 21 nt, Artificial Sequence
  CXCR4 targeting guide RNA
uugggaucagcaucgaauccu

SEQ ID NO: 1339 - RNA, 21 nt, Artificial Sequence
  CXCR4 targeting guide RNA
uuuccaggaggaugaaggauu

SEQ ID NO: 1340 - RNA, 22 nt, Artificial Sequence
  CXCR4 targeting guide RNA
aaggauucgaugcugaucccaa

SEQ ID NO: 1341 - RNA, 22 nt, Artificial Sequence
  CXCR4 targeting guide RNA
aauccuucauccuccuggaaau

SEQ ID NO: 1342 - RNA, 22 nt, Artificial Sequence
  CXCR4 targeting guide RNA
acauugggaucagcaucgaauc

SEQ ID NO: 1343 - RNA, 22 nt, Artificial Sequence
  CXCR4 targeting guide RNA
acuacauugggaucagcaucga

SEQ ID NO: 1344 - RNA, 22 nt, Artificial Sequence
  CXCR4 targeting guide RNA
agcaucgaauccuucauccucc

SEQ ID NO: 1345 - RNA, 22 nt, Artificial Sequence
  CXCR4 targeting guide RNA
aggaggaugaaggauucgaugc

SEQ ID NO: 1346 - RNA, 22 nt, Artificial Sequence
  CXCR4 targeting guide RNA
aggaugaaggauucgaugcuga

SEQ ID NO: 1347 - RNA, 22 nt, Artificial Sequence
  CXCR4 targeting guide RNA
aggauucgaugcugaucccaau

SEQ ID NO: 1348 - RNA, 22 nt, Artificial Sequence
  CXCR4 targeting guide RNA
aucagcaucgaauccuucaucc

SEQ ID NO: 1349 - RNA, 22 nt, Artificial Sequence
  CXCR4 targeting guide RNA
aucgaauccuucauccuccugg

SEQ ID NO: 1350 - RNA, 22 nt, Artificial Sequence
  CXCR4 targeting guide RNA
augaaggauucgaugcugaucc

SEQ ID NO: 1351 - RNA, 22 nt, Artificial Sequence
  CXCR4 targeting guide RNA
augauuuccaggaggaugaagg

SEQ ID NO: 1352 - RNA, 22 nt, Artificial Sequence
  CXCR4 targeting guide RNA
auucgaugcugaucccaaugua

SEQ ID NO: 1353 - RNA, 22 nt, Artificial Sequence
  CXCR4 targeting guide RNA
auugggaucagcaucgaauccu

SEQ ID NO: 1354 - RNA, 22 nt, Artificial Sequence
  CXCR4 targeting guide RNA
auuuccaggaggaugaaggauu

SEQ ID NO: 1355 - RNA, 22 nt, Artificial Sequence
  CXCR4 targeting guide RNA
cagcaucgaauccuucauccuc

SEQ ID NO: 1356 - RNA, 22 nt, Artificial Sequence
  CXCR4 targeting guide RNA
caggaggaugaaggauucgaug

SEQ ID NO: 1357 - RNA, 22 nt, Artificial Sequence
  CXCR4 targeting guide RNA
caucgaauccuucauccuccug

SEQ ID NO: 1358 - RNA, 22 nt, Artificial Sequence
  CXCR4 targeting guide RNA
cauugggaucagcaucgaaucc

SEQ ID NO: 1359 - RNA, 22 nt, Artificial Sequence
  CXCR4 targeting guide RNA
ccaggaggaugaaggauucgau

SEQ ID NO: 1360 - RNA, 22 nt, Artificial Sequence
  CXCR4 targeting guide RNA
cgaauccuucauccuccuggaa

SEQ ID NO: 1361 - RNA, 22 nt, Artificial Sequence
  CXCR4 targeting guide RNA
cuacauugggaucagcaucgaa

SEQ ID NO: 1362 - RNA, 22 nt, Artificial Sequence
  CXCR4 targeting guide RNA
cuuacuacauugggaucagcau

SEQ ID NO: 1363 - RNA, 22 nt, Artificial Sequence
  CXCR4 targeting guide RNA
gaaggauucgaugcugauccca

SEQ ID NO: 1364 - RNA, 22 nt, Artificial Sequence
  CXCR4 targeting guide RNA
gaauccuucauccuccuggaaa

SEQ ID NO: 1365 - RNA, 22 nt, Artificial Sequence
  CXCR4 targeting guide RNA
gaggaugaaggauucgaugcug

SEQ ID NO: 1366 - RNA, 22 nt, Artificial Sequence
  CXCR4 targeting guide RNA
gaucagcaucgaauccuucauc

SEQ ID NO: 1367 - RNA, 22 nt, Artificial Sequence
  CXCR4 targeting guide RNA
gaugaaggauucgaugcugauc

SEQ ID NO: 1368 - RNA, 22 nt, Artificial Sequence
  CXCR4 targeting guide RNA
gaugauuuccaggaggaugaag

SEQ ID NO: 1369 - RNA, 22 nt, Artificial Sequence
  CXCR4 targeting guide RNA
gauucgaugcugaucccaaugu

SEQ ID NO: 1370 - RNA, 22 nt, Artificial Sequence
  CXCR4 targeting guide RNA
gauuuccaggaggaugaaggau

SEQ ID NO: 1371 - RNA, 22 nt, Artificial Sequence
  CXCR4 targeting guide RNA
gcaucgaauccuucauccuccu

SEQ ID NO: 1372 - RNA, 22 nt, Artificial Sequence
  CXCR4 targeting guide RNA
ggaggaugaaggauucgaugcu

SEQ ID NO: 1373 - RNA, 22 nt, Artificial Sequence
  CXCR4 targeting guide RNA
ggaucagcaucgaauccuucau

SEQ ID NO: 1374 - RNA, 22 nt, Artificial Sequence
  CXCR4 targeting guide RNA
ggaugaaggauucgaugcugau

SEQ ID NO: 1375 - RNA, 22 nt, Artificial Sequence
  CXCR4 targeting guide RNA
ggauucgaugcugaucccaaug

SEQ ID NO: 1376 - RNA, 22 nt, Artificial Sequence
  CXCR4 targeting guide RNA
gggaucagcaucgaauccuuca

SEQ ID NO: 1377 - RNA, 22 nt, Artificial Sequence
  CXCR4 targeting guide RNA
uacauugggaucagcaucgaau

SEQ ID NO: 1378 - RNA, 22 nt, Artificial Sequence
  CXCR4 targeting guide RNA
uacuacauugggaucagcaucg

SEQ ID NO: 1379 - RNA, 22 nt, Artificial Sequence
  CXCR4 targeting guide RNA
ucagcaucgaauccuucauccu

SEQ ID NO: 1380 - RNA, 22 nt, Artificial Sequence
  CXCR4 targeting guide RNA
uccaggaggaugaaggauucga

SEQ ID NO: 1381 - RNA, 22 nt, Artificial Sequence
  CXCR4 targeting guide RNA
ucgaauccuucauccuccugga

SEQ ID NO: 1382 - RNA, 22 nt, Artificial Sequence
  CXCR4 targeting guide RNA
ugaaggauucgaugcugauccc

SEQ ID NO: 1383 - RNA, 22 nt, Artificial Sequence
  CXCR4 targeting guide RNA
ugauuuccaggaggaugaagga

SEQ ID NO: 1384 - RNA, 22 nt, Artificial Sequence
  CXCR4 targeting guide RNA
ugggaucagcaucgaauccuuc

SEQ ID NO: 1385 - RNA, 22 nt, Artificial Sequence
  CXCR4 targeting guide RNA
uuacuacauugggaucagcauc

SEQ ID NO: 1386 - RNA, 22 nt, Artificial Sequence
  CXCR4 targeting guide RNA
uuccaggaggaugaaggauucg

SEQ ID NO: 1387 - RNA, 22 nt, Artificial Sequence
  CXCR4 targeting guide RNA
uucgaugcugaucccaauguag

SEQ ID NO: 1388 - RNA, 22 nt, Artificial Sequence
  CXCR4 targeting guide RNA
uugggaucagcaucgaauccuu

SEQ ID NO: 1389 - RNA, 22 nt, Artificial Sequence
  CXCR4 targeting guide RNA
uuuccaggaggaugaaggauuc

SEQ ID NO: 1390 - RNA, 20 nt, Artificial Sequence
  CXCR4 targeting guide RNA
aaagccaggaugaggaggac

SEQ ID NO: 1391 - RNA, 20 nt, Artificial Sequence
  CXCR4 targeting guide RNA
aagaaagccaggaugaggag

SEQ ID NO: 1392 - RNA, 20 nt, Artificial Sequence
  CXCR4 targeting guide RNA
aagaccacaguccuccucau

SEQ ID NO: 1393 - RNA, 20 nt, Artificial Sequence
  CXCR4 targeting guide RNA
aagccaggaugaggaggacu

SEQ ID NO: 1394 - RNA, 20 nt, Artificial Sequence
  CXCR4 targeting guide RNA
aaggcccucaagaccacagu

SEQ ID NO: 1395 - RNA, 20 nt, Artificial Sequence
  CXCR4 targeting guide RNA
acaguccuccucauccuggc

SEQ ID NO: 1396 - RNA, 20 nt, Artificial Sequence
  CXCR4 targeting guide RNA
accacaguccuccucauccu

SEQ ID NO: 1397 - RNA, 20 nt, Artificial Sequence
  CXCR4 targeting guide RNA
agaaagccaggaugaggagg

SEQ ID NO: 1398 - RNA, 20 nt, Artificial Sequence
  CXCR4 targeting guide RNA
agaccacaguccuccucauc

SEQ ID NO: 1399 - RNA, 20 nt, Artificial Sequence
  CXCR4 targeting guide RNA
agccaggaugaggaggacug

SEQ ID NO: 1400 - RNA, 20 nt, Artificial Sequence
  CXCR4 targeting guide RNA
aggacuguggucuugagggc

SEQ ID NO: 1401 - RNA, 20 nt, Artificial Sequence
  CXCR4 targeting guide RNA
aggaggacuguggucuugag

SEQ ID NO: 1402 - RNA, 20 nt, Artificial Sequence
  CXCR4 targeting guide RNA
aggaugaggaggacuguggu

SEQ ID NO: 1403 - RNA, 20 nt, Artificial Sequence
  CXCR4 targeting guide RNA
aggcccucaagaccacaguc

SEQ ID NO: 1404 - RNA, 20 nt, Artificial Sequence
  CXCR4 targeting guide RNA
aguccuccucauccuggcuu

SEQ ID NO: 1405 - RNA, 20 nt, Artificial Sequence
  CXCR4 targeting guide RNA
augaggaggacuguggucuu

SEQ ID NO: 1406 - RNA, 20 nt, Artificial Sequence
  CXCR4 targeting guide RNA
caagaccacaguccuccuca

SEQ ID NO: 1407 - RNA, 20 nt, Artificial Sequence
  CXCR4 targeting guide RNA
caaggcccucaagaccacag

SEQ ID NO: 1408 - RNA, 20 nt, Artificial Sequence
  CXCR4 targeting guide RNA
cacaguccuccucauccugg

SEQ ID NO: 1409 - RNA, 20 nt, Artificial Sequence
  CXCR4 targeting guide RNA
caggaugaggaggacugugg

SEQ ID NO: 1410 - RNA, 20 nt, Artificial Sequence
  CXCR4 targeting guide RNA
caguccuccucauccuggcu

SEQ ID NO: 1411 - RNA, 20 nt, Artificial Sequence
  CXCR4 targeting guide RNA
ccacaguccuccucauccug

SEQ ID NO: 1412 - RNA, 20 nt, Artificial Sequence
  CXCR4 targeting guide RNA
ccaggaugaggaggacugug

SEQ ID NO: 1413 - RNA, 20 nt, Artificial Sequence
  CXCR4 targeting guide RNA
cccucaagaccacaguccuc

SEQ ID NO: 1414 - RNA, 20 nt, Artificial Sequence
  CXCR4 targeting guide RNA
ccucaagaccacaguccucc

SEQ ID NO: 1415 - RNA, 20 nt, Artificial Sequence
  CXCR4 targeting guide RNA
ccuccucauccuggcuuucu

SEQ ID NO: 1416 - RNA, 20 nt, Artificial Sequence
  CXCR4 targeting guide RNA
cgaagaaagccaggaugagg

SEQ ID NO: 1417 - RNA, 20 nt, Artificial Sequence
  CXCR4 targeting guide RNA
cucaagaccacaguccuccu

SEQ ID NO: 1418 - RNA, 20 nt, Artificial Sequence
  CXCR4 targeting guide RNA
gaaagccaggaugaggagga

SEQ ID NO: 1419 - RNA, 20 nt, Artificial Sequence
  CXCR4 targeting guide RNA
gaagaaagccaggaugagga

SEQ ID NO: 1420 - RNA, 20 nt, Artificial Sequence
  CXCR4 targeting guide RNA
gaccacaguccuccucaucc

SEQ ID NO: 1421 - RNA, 20 nt, Artificial Sequence
  CXCR4 targeting guide RNA
gaggacuguggucuugaggg

SEQ ID NO: 1422 - RNA, 20 nt, Artificial Sequence
  CXCR4 targeting guide RNA
gaggaggacuguggucuuga

SEQ ID NO: 1423 - RNA, 20 nt, Artificial Sequence
  CXCR4 targeting guide RNA
gaugaggaggacuguggucu

SEQ ID NO: 1424 - RNA, 20 nt, Artificial Sequence
  CXCR4 targeting guide RNA
gcaaggcccucaagaccaca

SEQ ID NO: 1425 - RNA, 20 nt, Artificial Sequence
  CXCR4 targeting guide RNA
gccaggaugaggaggacugu

SEQ ID NO: 1426 - RNA, 20 nt, Artificial Sequence
  CXCR4 targeting guide RNA
gcccucaagaccacaguccu

SEQ ID NO: 1427 - RNA, 20 nt, Artificial Sequence
  CXCR4 targeting guide RNA
gcgaagaaagccaggaugag

SEQ ID NO: 1428 - RNA, 20 nt, Artificial Sequence
  CXCR4 targeting guide RNA
ggacuguggucuugagggcc

SEQ ID NO: 1429 - RNA, 20 nt, Artificial Sequence
  CXCR4 targeting guide RNA
ggaggacuguggucuugagg

SEQ ID NO: 1430 - RNA, 20 nt, Artificial Sequence
  CXCR4 targeting guide RNA
ggaugaggaggacugugguc

SEQ ID NO: 1431 - RNA, 20 nt, Artificial Sequence
  CXCR4 targeting guide RNA
ggcccucaagaccacagucc

SEQ ID NO: 1432 - RNA, 20 nt, Artificial Sequence
  CXCR4 targeting guide RNA
guccuccucauccuggcuuu

SEQ ID NO: 1433 - RNA, 20 nt, Artificial Sequence
  CXCR4 targeting guide RNA
ucaagaccacaguccuccuc

SEQ ID NO: 1434 - RNA, 20 nt, Artificial Sequence
  CXCR4 targeting guide RNA
uccuccucauccuggcuuuc

SEQ ID NO: 1435 - RNA, 20 nt, Artificial Sequence
  CXCR4 targeting guide RNA
ugaggaggacuguggucuug

SEQ ID NO: 1436 - RNA, 21 nt, Artificial Sequence
  CXCR4 targeting guide RNA
aaagccaggaugaggaggacu

SEQ ID NO: 1437 - RNA, 21 nt, Artificial Sequence
  CXCR4 targeting guide RNA
aagaaagccaggaugaggagg

SEQ ID NO: 1438 - RNA, 21 nt, Artificial Sequence
  CXCR4 targeting guide RNA
aagaccacaguccuccucauc

SEQ ID NO: 1439 - RNA, 21 nt, Artificial Sequence
  CXCR4 targeting guide RNA
aagccaggaugaggaggacug

SEQ ID NO: 1440 - RNA, 21 nt, Artificial Sequence
  CXCR4 targeting guide RNA
aaggcccucaagaccacaguc

SEQ ID NO: 1441 - RNA, 21 nt, Artificial Sequence
  CXCR4 targeting guide RNA
acaguccuccucauccuggcu

SEQ ID NO: 1442 - RNA, 21 nt, Artificial Sequence
  CXCR4 targeting guide RNA
accacaguccuccucauccug

SEQ ID NO: 1443 - RNA, 21 nt, Artificial Sequence
  CXCR4 targeting guide RNA
agaaagccaggaugaggagga

SEQ ID NO: 1444 - RNA, 21 nt, Artificial Sequence
  CXCR4 targeting guide RNA
agaccacaguccuccucaucc

SEQ ID NO: 1445 - RNA, 21 nt, Artificial Sequence
  CXCR4 targeting guide RNA
agccaggaugaggaggacugu

SEQ ID NO: 1446 - RNA, 21 nt, Artificial Sequence
  CXCR4 targeting guide RNA
aggacuguggucuugagggcc

SEQ ID NO: 1447 - RNA, 21 nt, Artificial Sequence
  CXCR4 targeting guide RNA
aggaggacuguggucuugagg

SEQ ID NO: 1448 - RNA, 21 nt, Artificial Sequence
  CXCR4 targeting guide RNA
aggaugaggaggacugugguc

SEQ ID NO: 1449 - RNA, 21 nt, Artificial Sequence
  CXCR4 targeting guide RNA
aggcccucaagaccacagucc

SEQ ID NO: 1450 - RNA, 21 nt, Artificial Sequence
  CXCR4 targeting guide RNA
aguccuccucauccuggcuuu

SEQ ID NO: 1451 - RNA, 21 nt, Artificial Sequence
  CXCR4 targeting guide RNA
augaggaggacuguggucuug

SEQ ID NO: 1452 - RNA, 21 nt, Artificial Sequence
  CXCR4 targeting guide RNA
caagaccacaguccuccucau

SEQ ID NO: 1453 - RNA, 21 nt, Artificial Sequence
  CXCR4 targeting guide RNA
caaggcccucaagaccacagu

SEQ ID NO: 1454 - RNA, 21 nt, Artificial Sequence
  CXCR4 targeting guide RNA
cacaguccuccucauccuggc

SEQ ID NO: 1455 - RNA, 21 nt, Artificial Sequence
  CXCR4 targeting guide RNA
caggaugaggaggacuguggu

SEQ ID NO: 1456 - RNA, 21 nt, Artificial Sequence
  CXCR4 targeting guide RNA
caguccuccucauccuggcuu

SEQ ID NO: 1457 - RNA, 21 nt, Artificial Sequence
  CXCR4 targeting guide RNA
ccacaguccuccucauccugg

SEQ ID NO: 1458 - RNA, 21 nt, Artificial Sequence
  CXCR4 targeting guide RNA
ccaggaugaggaggacugugg

SEQ ID NO: 1459 - RNA, 21 nt, Artificial Sequence
  CXCR4 targeting guide RNA
cccucaagaccacaguccucc

SEQ ID NO: 1460 - RNA, 21 nt, Artificial Sequence
  CXCR4 targeting guide RNA
ccucaagaccacaguccuccu

SEQ ID NO: 1461 - RNA, 21 nt, Artificial Sequence
  CXCR4 targeting guide RNA
ccuccucauccuggcuuucuu

SEQ ID NO: 1462 - RNA, 21 nt, Artificial Sequence
  CXCR4 targeting guide RNA
cgaagaaagccaggaugagga

SEQ ID NO: 1463 - RNA, 21 nt, Artificial Sequence
  CXCR4 targeting guide RNA
cgcaaggcccucaagaccaca

SEQ ID NO: 1464 - RNA, 21 nt, Artificial Sequence
  CXCR4 targeting guide RNA
cucaagaccacaguccuccuc

SEQ ID NO: 1465 - RNA, 21 nt, Artificial Sequence
  CXCR4 targeting guide RNA
gaaagccaggaugaggaggac

SEQ ID NO: 1466 - RNA, 21 nt, Artificial Sequence
  CXCR4 targeting guide RNA
gaagaaagccaggaugaggag

SEQ ID NO: 1467 - RNA, 21 nt, Artificial Sequence
  CXCR4 targeting guide RNA
gaccacaguccuccucauccu

SEQ ID NO: 1468 - RNA, 21 nt, Artificial Sequence
  CXCR4 targeting guide RNA
gaggacuguggucuugagggc

SEQ ID NO: 1469 - RNA, 21 nt, Artificial Sequence
  CXCR4 targeting guide RNA
gaggaggacuguggucuugag

SEQ ID NO: 1470 - RNA, 21 nt, Artificial Sequence
  CXCR4 targeting guide RNA
gaugaggaggacuguggucuu

SEQ ID NO: 1471 - RNA, 21 nt, Artificial Sequence
  CXCR4 targeting guide RNA
gcaaggcccucaagaccacag

SEQ ID NO: 1472 - RNA, 21 nt, Artificial Sequence
  CXCR4 targeting guide RNA
gccaggaugaggaggacugug

SEQ ID NO: 1473 - RNA, 21 nt, Artificial Sequence
  CXCR4 targeting guide RNA
gcccucaagaccacaguccuc

SEQ ID NO: 1474 - RNA, 21 nt, Artificial Sequence
  CXCR4 targeting guide RNA
gcgaagaaagccaggaugagg

SEQ ID NO: 1475 - RNA, 21 nt, Artificial Sequence
  CXCR4 targeting guide RNA
ggacuguggucuugagggccu

SEQ ID NO: 1476 - RNA, 21 nt, Artificial Sequence
  CXCR4 targeting guide RNA
ggaggacuguggucuugaggg

SEQ ID NO: 1477 - RNA, 21 nt, Artificial Sequence
  CXCR4 targeting guide RNA
ggaugaggaggacuguggucu

SEQ ID NO: 1478 - RNA, 21 nt, Artificial Sequence
  CXCR4 targeting guide RNA
ggcccucaagaccacaguccu

SEQ ID NO: 1479 - RNA, 21 nt, Artificial Sequence
  CXCR4 targeting guide RNA
ggcgaagaaagccaggaugag

SEQ ID NO: 1480 - RNA, 21 nt, Artificial Sequence
  CXCR4 targeting guide RNA
guccuccucauccuggcuuuc

SEQ ID NO: 1481 - RNA, 21 nt, Artificial Sequence
  CXCR4 targeting guide RNA
ucaagaccacaguccuccuca

SEQ ID NO: 1482 - RNA, 21 nt, Artificial Sequence
  CXCR4 targeting guide RNA
uccuccucauccuggcuuucu

SEQ ID NO: 1483 - RNA, 21 nt, Artificial Sequence
  CXCR4 targeting guide RNA
ugaggaggacuguggucuuga

SEQ ID NO: 1484 - RNA, 22 nt, Artificial Sequence
  CXCR4 targeting guide RNA
aaagccaggaugaggaggacug

SEQ ID NO: 1485 - RNA, 22 nt, Artificial Sequence
  CXCR4 targeting guide RNA
aagaaagccaggaugaggagga

SEQ ID NO: 1486 - RNA, 22 nt, Artificial Sequence
  CXCR4 targeting guide RNA
aagaccacaguccuccucaucc

SEQ ID NO: 1487 - RNA, 22 nt, Artificial Sequence
  CXCR4 targeting guide RNA
aagccaggaugaggaggacugu

SEQ ID NO: 1488 - RNA, 22 nt, Artificial Sequence
  CXCR4 targeting guide RNA
aaggcccucaagaccacagucc

SEQ ID NO: 1489 - RNA, 22 nt, Artificial Sequence
  CXCR4 targeting guide RNA
acaguccuccucauccuggcuu

SEQ ID NO: 1490 - RNA, 22 nt, Artificial Sequence
  CXCR4 targeting guide RNA
accacaguccuccucauccugg

SEQ ID NO: 1491 - RNA, 22 nt, Artificial Sequence
  CXCR4 targeting guide RNA
agaaagccaggaugaggaggac

SEQ ID NO: 1492 - RNA, 22 nt, Artificial Sequence
  CXCR4 targeting guide RNA
agaccacaguccuccucauccu

SEQ ID NO: 1493 - RNA, 22 nt, Artificial Sequence
  CXCR4 targeting guide RNA
agccaggaugaggaggacugug

SEQ ID NO: 1494 - RNA, 22 nt, Artificial Sequence
  CXCR4 targeting guide RNA
aggacuguggucuugagggccu

SEQ ID NO: 1495 - RNA, 22 nt, Artificial Sequence
  CXCR4 targeting guide RNA
aggaggacuguggucuugaggg

SEQ ID NO: 1496 - RNA, 22 nt, Artificial Sequence
  CXCR4 targeting guide RNA
aggaugaggaggacuguggucu

SEQ ID NO: 1497 - RNA, 22 nt, Artificial Sequence
  CXCR4 targeting guide RNA
aggcccucaagaccacaguccu

SEQ ID NO: 1498 - RNA, 22 nt, Artificial Sequence
  CXCR4 targeting guide RNA
aggcgaagaaagccaggaugag

SEQ ID NO: 1499 - RNA, 22 nt, Artificial Sequence
  CXCR4 targeting guide RNA
aguccuccucauccuggcuuuc

SEQ ID NO: 1500 - RNA, 22 nt, Artificial Sequence
  CXCR4 targeting guide RNA
augaggaggacuguggucuuga

SEQ ID NO: 1501 - RNA, 22 nt, Artificial Sequence
  CXCR4 targeting guide RNA
caagaccacaguccuccucauc

SEQ ID NO: 1502 - RNA, 22 nt, Artificial Sequence
  CXCR4 targeting guide RNA
caaggcccucaagaccacaguc

SEQ ID NO: 1503 - RNA, 22 nt, Artificial Sequence
  CXCR4 targeting guide RNA
cacaguccuccucauccuggcu

SEQ ID NO: 1504 - RNA, 22 nt, Artificial Sequence
  CXCR4 targeting guide RNA
caggaugaggaggacugugguc

SEQ ID NO: 1505 - RNA, 22 nt, Artificial Sequence
  CXCR4 targeting guide RNA
caguccuccucauccuggcuuu

SEQ ID NO: 1506 - RNA, 22 nt, Artificial Sequence
  CXCR4 targeting guide RNA
ccacaguccuccucauccuggc

SEQ ID NO: 1507 - RNA, 22 nt, Artificial Sequence
  CXCR4 targeting guide RNA
ccaggaugaggaggacuguggu

SEQ ID NO: 1508 - RNA, 22 nt, Artificial Sequence
  CXCR4 targeting guide RNA
cccucaagaccacaguccuccu

SEQ ID NO: 1509 - RNA, 22 nt, Artificial Sequence
  CXCR4 targeting guide RNA
ccucaagaccacaguccuccuc

SEQ ID NO: 1510 - RNA, 22 nt, Artificial Sequence
  CXCR4 targeting guide RNA
ccuccucauccuggcuuucuuc

SEQ ID NO: 1511 - RNA, 22 nt, Artificial Sequence
  CXCR4 targeting guide RNA
cgaagaaagccaggaugaggag

SEQ ID NO: 1512 - RNA, 22 nt, Artificial Sequence
  CXCR4 targeting guide RNA
cgcaaggcccucaagaccacag

SEQ ID NO: 1513 - RNA, 22 nt, Artificial Sequence
  CXCR4 targeting guide RNA
cucaagaccacaguccuccuca

SEQ ID NO: 1514 - RNA, 22 nt, Artificial Sequence
  CXCR4 targeting guide RNA
gaaagccaggaugaggaggacu

SEQ ID NO: 1515 - RNA, 22 nt, Artificial Sequence
  CXCR4 targeting guide RNA
gaagaaagccaggaugaggagg

SEQ ID NO: 1516 - RNA, 22 nt, Artificial Sequence
  CXCR4 targeting guide RNA
gaccacaguccuccucauccug

SEQ ID NO: 1517 - RNA, 22 nt, Artificial Sequence
  CXCR4 targeting guide RNA
gaggacuguggucuugagggcc

SEQ ID NO: 1518 - RNA, 22 nt, Artificial Sequence
  CXCR4 targeting guide RNA
gaggaggacuguggucuugagg

SEQ ID NO: 1519 - RNA, 22 nt, Artificial Sequence
  CXCR4 targeting guide RNA
gaugaggaggacuguggucuug

SEQ ID NO: 1520 - RNA, 22 nt, Artificial Sequence
  CXCR4 targeting guide RNA
gcaaggcccucaagaccacagu

SEQ ID NO: 1521 - RNA, 22 nt, Artificial Sequence
  CXCR4 targeting guide RNA
gccaggaugaggaggacugugg

SEQ ID NO: 1522 - RNA, 22 nt, Artificial Sequence
  CXCR4 targeting guide RNA
gcccucaagaccacaguccucc

SEQ ID NO: 1523 - RNA, 22 nt, Artificial Sequence
  CXCR4 targeting guide RNA
gcgaagaaagccaggaugagga

SEQ ID NO: 1524 - RNA, 22 nt, Artificial Sequence
  CXCR4 targeting guide RNA
gcgcaaggcccucaagaccaca

SEQ ID NO: 1525 - RNA, 22 nt, Artificial Sequence
  CXCR4 targeting guide RNA
ggacuguggucuugagggccuu

SEQ ID NO: 1526 - RNA, 22 nt, Artificial Sequence
  CXCR4 targeting guide RNA
ggaggacuguggucuugagggc

SEQ ID NO: 1527 - RNA, 22 nt, Artificial Sequence
  CXCR4 targeting guide RNA
ggaugaggaggacuguggucuu

SEQ ID NO: 1528 - RNA, 22 nt, Artificial Sequence
  CXCR4 targeting guide RNA
ggcccucaagaccacaguccuc

SEQ ID NO: 1529 - RNA, 22 nt, Artificial Sequence
  CXCR4 targeting guide RNA
ggcgaagaaagccaggaugagg

SEQ ID NO: 1530 - RNA, 22 nt, Artificial Sequence
  CXCR4 targeting guide RNA
guccuccucauccuggcuuucu

SEQ ID NO: 1531 - RNA, 22 nt, Artificial Sequence
  CXCR4 targeting guide RNA
ucaagaccacaguccuccucau

SEQ ID NO: 1532 - RNA, 22 nt, Artificial Sequence
  CXCR4 targeting guide RNA
uccuccucauccuggcuuucuu

SEQ ID NO: 1533 - RNA, 22 nt, Artificial Sequence
  CXCR4 targeting guide RNA
ugaggaggacuguggucuugag

SEQ ID NO: 1534 - RNA, 20 nt, Artificial Sequence
  CXCR4 targeting guide RNA
aagcacaaggcccucaagac

SEQ ID NO: 1535 - RNA, 20 nt, Artificial Sequence
  CXCR4 targeting guide RNA
aagggccaccagaagcacaa

SEQ ID NO: 1536 - RNA, 20 nt, Artificial Sequence
  CXCR4 targeting guide RNA
acacuccaagggccaccaga

SEQ ID NO: 1537 - RNA, 20 nt, Artificial Sequence
  CXCR4 targeting guide RNA
accagaagcacaaggcccuc

SEQ ID NO: 1538 - RNA, 20 nt, Artificial Sequence
  CXCR4 targeting guide RNA
acuccaagggccaccagaag

SEQ ID NO: 1539 - RNA, 20 nt, Artificial Sequence
  CXCR4 targeting guide RNA
acuguggucuugagggccuu

SEQ ID NO: 1540 - RNA, 20 nt, Artificial Sequence
  CXCR4 targeting guide RNA
agaagcacaaggcccucaag

SEQ ID NO: 1541 - RNA, 20 nt, Artificial Sequence
  CXCR4 targeting guide RNA
agcacaaggcccucaagacc

SEQ ID NO: 1542 - RNA, 20 nt, Artificial Sequence
  CXCR4 targeting guide RNA
agggccaccagaagcacaag

SEQ ID NO: 1543 - RNA, 20 nt, Artificial Sequence
  CXCR4 targeting guide RNA
agggccuugugcuucuggug

SEQ ID NO: 1544 - RNA, 20 nt, Artificial Sequence
  CXCR4 targeting guide RNA
caagggccaccagaagcaca

SEQ ID NO: 1545 - RNA, 20 nt, Artificial Sequence
  CXCR4 targeting guide RNA
cacaaggcccucaagaccac

SEQ ID NO: 1546 - RNA, 20 nt, Artificial Sequence
  CXCR4 targeting guide RNA
caccagaagcacaaggcccu

SEQ ID NO: 1547 - RNA, 20 nt, Artificial Sequence
  CXCR4 targeting guide RNA
cacuccaagggccaccagaa

SEQ ID NO: 1548 - RNA, 20 nt, Artificial Sequence
  CXCR4 targeting guide RNA
cagaagcacaaggcccucaa

SEQ ID NO: 1549 - RNA, 20 nt, Artificial Sequence
  CXCR4 targeting guide RNA
ccaagggccaccagaagcac

SEQ ID NO: 1550 - RNA, 20 nt, Artificial Sequence
  CXCR4 targeting guide RNA
ccaccagaagcacaaggccc

SEQ ID NO: 1551 - RNA, 20 nt, Artificial Sequence
  CXCR4 targeting guide RNA
ccagaagcacaaggcccuca

SEQ ID NO: 1552 - RNA, 20 nt, Artificial Sequence
  CXCR4 targeting guide RNA
ccuugugcuucugguggccc

SEQ ID NO: 1553 - RNA, 20 nt, Artificial Sequence
  CXCR4 targeting guide RNA
cuccaagggccaccagaagc

SEQ ID NO: 1554 - RNA, 20 nt, Artificial Sequence
  CXCR4 targeting guide RNA
cuguggucuugagggccuug

SEQ ID NO: 1555 - RNA, 20 nt, Artificial Sequence
  CXCR4 targeting guide RNA
cuugagggccuugugcuucu

SEQ ID NO: 1556 - RNA, 20 nt, Artificial Sequence
  CXCR4 targeting guide RNA
cuugugcuucugguggcccu

SEQ ID NO: 1557 - RNA, 20 nt, Artificial Sequence
  CXCR4 targeting guide RNA
gaagcacaaggcccucaaga

SEQ ID NO: 1558 - RNA, 20 nt, Artificial Sequence
  CXCR4 targeting guide RNA
gacuguggucuugagggccu

SEQ ID NO: 1559 - RNA, 20 nt, Artificial Sequence
  CXCR4 targeting guide RNA
gagggccuugugcuucuggu

SEQ ID NO: 1560 - RNA, 20 nt, Artificial Sequence
  CXCR4 targeting guide RNA
gcacaaggcccucaagacca

SEQ ID NO: 1561 - RNA, 20 nt, Artificial Sequence
  CXCR4 targeting guide RNA
gccaccagaagcacaaggcc

SEQ ID NO: 1562 - RNA, 20 nt, Artificial Sequence
  CXCR4 targeting guide RNA
gccuugugcuucugguggcc

SEQ ID NO: 1563 - RNA, 20 nt, Artificial Sequence
  CXCR4 targeting guide RNA
ggccaccagaagcacaaggc

SEQ ID NO: 1564 - RNA, 20 nt, Artificial Sequence
  CXCR4 targeting guide RNA
ggccuugugcuucugguggc

SEQ ID NO: 1565 - RNA, 20 nt, Artificial Sequence
  CXCR4 targeting guide RNA
gggccaccagaagcacaagg

SEQ ID NO: 1566 - RNA, 20 nt, Artificial Sequence
  CXCR4 targeting guide RNA
gggccuugugcuucuggugg

SEQ ID NO: 1567 - RNA, 20 nt, Artificial Sequence
  CXCR4 targeting guide RNA
ggucuugagggccuugugcu

SEQ ID NO: 1568 - RNA, 20 nt, Artificial Sequence
  CXCR4 targeting guide RNA
gucuugagggccuugugcuu

SEQ ID NO: 1569 - RNA, 20 nt, Artificial Sequence
  CXCR4 targeting guide RNA
gugcuucugguggcccuugg

SEQ ID NO: 1570 - RNA, 20 nt, Artificial Sequence
  CXCR4 targeting guide RNA
guggucuugagggccuugug

SEQ ID NO: 1571 - RNA, 20 nt, Artificial Sequence
  CXCR4 targeting guide RNA
uccaagggccaccagaagca

SEQ ID NO: 1572 - RNA, 20 nt, Artificial Sequence
  CXCR4 targeting guide RNA
ucuugagggccuugugcuuc

SEQ ID NO: 1573 - RNA, 20 nt, Artificial Sequence
  CXCR4 targeting guide RNA
ugagggccuugugcuucugg

SEQ ID NO: 1574 - RNA, 20 nt, Artificial Sequence
  CXCR4 targeting guide RNA
ugcuucugguggcccuugga

SEQ ID NO: 1575 - RNA, 20 nt, Artificial Sequence
  CXCR4 targeting guide RNA
uggucuugagggccuugugc

SEQ ID NO: 1576 - RNA, 20 nt, Artificial Sequence
  CXCR4 targeting guide RNA
ugugcuucugguggcccuug

SEQ ID NO: 1577 - RNA, 20 nt, Artificial Sequence
  CXCR4 targeting guide RNA
uguggucuugagggccuugu

SEQ ID NO: 1578 - RNA, 20 nt, Artificial Sequence
  CXCR4 targeting guide RNA
uugagggccuugugcuucug

SEQ ID NO: 1579 - RNA, 20 nt, Artificial Sequence
  CXCR4 targeting guide RNA
uugugcuucugguggcccuu

SEQ ID NO: 1580 - RNA, 21 nt, Artificial Sequence
  CXCR4 targeting guide RNA
aagcacaaggcccucaagacc

SEQ ID NO: 1581 - RNA, 21 nt, Artificial Sequence
  CXCR4 targeting guide RNA
aagggccaccagaagcacaag

SEQ ID NO: 1582 - RNA, 21 nt, Artificial Sequence
  CXCR4 targeting guide RNA
acacuccaagggccaccagaa

SEQ ID NO: 1583 - RNA, 21 nt, Artificial Sequence
  CXCR4 targeting guide RNA
accagaagcacaaggcccuca

SEQ ID NO: 1584 - RNA, 21 nt, Artificial Sequence
  CXCR4 targeting guide RNA
acuccaagggccaccagaagc

SEQ ID NO: 1585 - RNA, 21 nt, Artificial Sequence
  CXCR4 targeting guide RNA
acuguggucuugagggccuug

SEQ ID NO: 1586 - RNA, 21 nt, Artificial Sequence
  CXCR4 targeting guide RNA
agaagcacaaggcccucaaga

SEQ ID NO: 1587 - RNA, 21 nt, Artificial Sequence
  CXCR4 targeting guide RNA
agcacaaggcccucaagacca

SEQ ID NO: 1588 - RNA, 21 nt, Artificial Sequence
  CXCR4 targeting guide RNA
agggccaccagaagcacaagg

SEQ ID NO: 1589 - RNA, 21 nt, Artificial Sequence
  CXCR4 targeting guide RNA
agggccuugugcuucuggugg

SEQ ID NO: 1590 - RNA, 21 nt, Artificial Sequence
  CXCR4 targeting guide RNA
caagggccaccagaagcacaa

SEQ ID NO: 1591 - RNA, 21 nt, Artificial Sequence
  CXCR4 targeting guide RNA
cacaaggcccucaagaccaca

SEQ ID NO: 1592 - RNA, 21 nt, Artificial Sequence
  CXCR4 targeting guide RNA
cacacuccaagggccaccaga

SEQ ID NO: 1593 - RNA, 21 nt, Artificial Sequence
  CXCR4 targeting guide RNA
caccagaagcacaaggcccuc

SEQ ID NO: 1594 - RNA, 21 nt, Artificial Sequence
  CXCR4 targeting guide RNA
cacuccaagggccaccagaag

SEQ ID NO: 1595 - RNA, 21 nt, Artificial Sequence
  CXCR4 targeting guide RNA
cagaagcacaaggcccucaag

SEQ ID NO: 1596 - RNA, 21 nt, Artificial Sequence
  CXCR4 targeting guide RNA
ccaagggccaccagaagcaca

SEQ ID NO: 1597 - RNA, 21 nt, Artificial Sequence
  CXCR4 targeting guide RNA
ccaccagaagcacaaggcccu

SEQ ID NO: 1598 - RNA, 21 nt, Artificial Sequence
  CXCR4 targeting guide RNA
ccagaagcacaaggcccucaa

SEQ ID NO: 1599 - RNA, 21 nt, Artificial Sequence
  CXCR4 targeting guide RNA
ccuugugcuucugguggcccu

SEQ ID NO: 1600 - RNA, 21 nt, Artificial Sequence
  CXCR4 targeting guide RNA
cuccaagggccaccagaagca

SEQ ID NO: 1601 - RNA, 21 nt, Artificial Sequence
  CXCR4 targeting guide RNA
cuguggucuugagggccuugu

SEQ ID NO: 1602 - RNA, 21 nt, Artificial Sequence
  CXCR4 targeting guide RNA
cuugagggccuugugcuucug

SEQ ID NO: 1603 - RNA, 21 nt, Artificial Sequence
  CXCR4 targeting guide RNA
cuugugcuucugguggcccuu

SEQ ID NO: 1604 - RNA, 21 nt, Artificial Sequence
  CXCR4 targeting guide RNA
gaagcacaaggcccucaagac

SEQ ID NO: 1605 - RNA, 21 nt, Artificial Sequence
  CXCR4 targeting guide RNA
gacuguggucuugagggccuu

SEQ ID NO: 1606 - RNA, 21 nt, Artificial Sequence
  CXCR4 targeting guide RNA
gagggccuugugcuucuggug

SEQ ID NO: 1607 - RNA, 21 nt, Artificial Sequence
  CXCR4 targeting guide RNA
gcacaaggcccucaagaccac

SEQ ID NO: 1608 - RNA, 21 nt, Artificial Sequence
  CXCR4 targeting guide RNA
gccaccagaagcacaaggccc

SEQ ID NO: 1609 - RNA, 21 nt, Artificial Sequence
  CXCR4 targeting guide RNA
gccuugugcuucugguggccc

SEQ ID NO: 1610 - RNA, 21 nt, Artificial Sequence
  CXCR4 targeting guide RNA
ggccaccagaagcacaaggcc

SEQ ID NO: 1611 - RNA, 21 nt, Artificial Sequence
  CXCR4 targeting guide RNA
ggccuugugcuucugguggcc

SEQ ID NO: 1612 - RNA, 21 nt, Artificial Sequence
  CXCR4 targeting guide RNA
gggccaccagaagcacaaggc

SEQ ID NO: 1613 - RNA, 21 nt, Artificial Sequence
  CXCR4 targeting guide RNA
gggccuugugcuucugguggc

SEQ ID NO: 1614 - RNA, 21 nt, Artificial Sequence
  CXCR4 targeting guide RNA
ggucuugagggccuugugcuu

SEQ ID NO: 1615 - RNA, 21 nt, Artificial Sequence
  CXCR4 targeting guide RNA
gucuugagggccuugugcuuc

SEQ ID NO: 1616 - RNA, 21 nt, Artificial Sequence
  CXCR4 targeting guide RNA
gugcuucugguggcccuugga

SEQ ID NO: 1617 - RNA, 21 nt, Artificial Sequence
  CXCR4 targeting guide RNA
guggucuugagggccuugugc

SEQ ID NO: 1618 - RNA, 21 nt, Artificial Sequence
  CXCR4 targeting guide RNA
uccaagggccaccagaagcac

SEQ ID NO: 1619 - RNA, 21 nt, Artificial Sequence
  CXCR4 targeting guide RNA
ucuugagggccuugugcuucu

SEQ ID NO: 1620 - RNA, 21 nt, Artificial Sequence
  CXCR4 targeting guide RNA
ugacuguggucuugagggccu

SEQ ID NO: 1621 - RNA, 21 nt, Artificial Sequence
  CXCR4 targeting guide RNA
ugagggccuugugcuucuggu

SEQ ID NO: 1622 - RNA, 21 nt, Artificial Sequence
  CXCR4 targeting guide RNA
ugcuucugguggcccuuggag

SEQ ID NO: 1623 - RNA, 21 nt, Artificial Sequence
  CXCR4 targeting guide RNA
uggucuugagggccuugugcu

SEQ ID NO: 1624 - RNA, 21 nt, Artificial Sequence
  CXCR4 targeting guide RNA
ugugcuucugguggcccuugg

SEQ ID NO: 1625 - RNA, 21 nt, Artificial Sequence
  CXCR4 targeting guide RNA
uguggucuugagggccuugug

SEQ ID NO: 1626 - RNA, 21 nt, Artificial Sequence
  CXCR4 targeting guide RNA
uugagggccuugugcuucugg

SEQ ID NO: 1627 - RNA, 21 nt, Artificial Sequence
  CXCR4 targeting guide RNA
uugugcuucugguggcccuug

SEQ ID NO: 1628 - RNA, 22 nt, Artificial Sequence
  CXCR4 targeting guide RNA
aagcacaaggcccucaagacca

SEQ ID NO: 1629 - RNA, 22 nt, Artificial Sequence
  CXCR4 targeting guide RNA
aagggccaccagaagcacaagg

SEQ ID NO: 1630 - RNA, 22 nt, Artificial Sequence
  CXCR4 targeting guide RNA
acacuccaagggccaccagaag

SEQ ID NO: 1631 - RNA, 22 nt, Artificial Sequence
  CXCR4 targeting guide RNA
accagaagcacaaggcccucaa

SEQ ID NO: 1632 - RNA, 22 nt, Artificial Sequence
  CXCR4 targeting guide RNA
acuccaagggccaccagaagca

SEQ ID NO: 1633 - RNA, 22 nt, Artificial Sequence
  CXCR4 targeting guide RNA
acuguggucuugagggccuugu

SEQ ID NO: 1634 - RNA, 22 nt, Artificial Sequence
  CXCR4 targeting guide RNA
agaagcacaaggcccucaagac

SEQ ID NO: 1635 - RNA, 22 nt, Artificial Sequence
  CXCR4 targeting guide RNA
agcacaaggcccucaagaccac

SEQ ID NO: 1636 - RNA, 22 nt, Artificial Sequence
  CXCR4 targeting guide RNA
agggccaccagaagcacaaggc

SEQ ID NO: 1637 - RNA, 22 nt, Artificial Sequence
  CXCR4 targeting guide RNA
agggccuugugcuucugguggc

SEQ ID NO: 1638 - RNA, 22 nt, Artificial Sequence
  CXCR4 targeting guide RNA
augacuguggucuugagggccu

SEQ ID NO: 1639 - RNA, 22 nt, Artificial Sequence
  CXCR4 targeting guide RNA
caagggccaccagaagcacaag

SEQ ID NO: 1640 - RNA, 22 nt, Artificial Sequence
  CXCR4 targeting guide RNA
cacaaggcccucaagaccacag

SEQ ID NO: 1641 - RNA, 22 nt, Artificial Sequence
  CXCR4 targeting guide RNA
cacacuccaagggccaccagaa

SEQ ID NO: 1642 - RNA, 22 nt, Artificial Sequence
  CXCR4 targeting guide RNA
caccagaagcacaaggcccuca

SEQ ID NO: 1643 - RNA, 22 nt, Artificial Sequence
  CXCR4 targeting guide RNA
cacuccaagggccaccagaagc

SEQ ID NO: 1644 - RNA, 22 nt, Artificial Sequence
  CXCR4 targeting guide RNA
cagaagcacaaggcccucaaga

SEQ ID NO: 1645 - RNA, 22 nt, Artificial Sequence
  CXCR4 targeting guide RNA
ccaagggccaccagaagcacaa

SEQ ID NO: 1646 - RNA, 22 nt, Artificial Sequence
  CXCR4 targeting guide RNA
ccaccagaagcacaaggcccuc

SEQ ID NO: 1647 - RNA, 22 nt, Artificial Sequence
  CXCR4 targeting guide RNA
ccagaagcacaaggcccucaag

SEQ ID NO: 1648 - RNA, 22 nt, Artificial Sequence
  CXCR4 targeting guide RNA
ccuugugcuucugguggcccuu

SEQ ID NO: 1649 - RNA, 22 nt, Artificial Sequence
  CXCR4 targeting guide RNA
cuccaagggccaccagaagcac

SEQ ID NO: 1650 - RNA, 22 nt, Artificial Sequence
  CXCR4 targeting guide RNA
cuguggucuugagggccuugug

SEQ ID NO: 1651 - RNA, 22 nt, Artificial Sequence
  CXCR4 targeting guide RNA
cuugagggccuugugcuucugg

SEQ ID NO: 1652 - RNA, 22 nt, Artificial Sequence
  CXCR4 targeting guide RNA
cuugugcuucugguggcccuug

SEQ ID NO: 1653 - RNA, 22 nt, Artificial Sequence
  CXCR4 targeting guide RNA
gaagcacaaggcccucaagacc

SEQ ID NO: 1654 - RNA, 22 nt, Artificial Sequence
  CXCR4 targeting guide RNA
gacuguggucuugagggccuug

SEQ ID NO: 1655 - RNA, 22 nt, Artificial Sequence
  CXCR4 targeting guide RNA
gagggccuugugcuucuggugg

SEQ ID NO: 1656 - RNA, 22 nt, Artificial Sequence
  CXCR4 targeting guide RNA
gcacaaggcccucaagaccaca

SEQ ID NO: 1657 - RNA, 22 nt, Artificial Sequence
  CXCR4 targeting guide RNA
gccaccagaagcacaaggcccu

SEQ ID NO: 1658 - RNA, 22 nt, Artificial Sequence
  CXCR4 targeting guide RNA
gccuugugcuucugguggcccu

SEQ ID NO: 1659 - RNA, 22 nt, Artificial Sequence
  CXCR4 targeting guide RNA
ggccaccagaagcacaaggccc

SEQ ID NO: 1660 - RNA, 22 nt, Artificial Sequence
  CXCR4 targeting guide RNA
ggccuugugcuucugguggccc

SEQ ID NO: 1661 - RNA, 22 nt, Artificial Sequence
  CXCR4 targeting guide RNA
gggccaccagaagcacaaggcc

SEQ ID NO: 1662 - RNA, 22 nt, Artificial Sequence
  CXCR4 targeting guide RNA
gggccuugugcuucugguggcc

SEQ ID NO: 1663 - RNA, 22 nt, Artificial Sequence
  CXCR4 targeting guide RNA
ggucuugagggccuugugcuuc

SEQ ID NO: 1664 - RNA, 22 nt, Artificial Sequence
  CXCR4 targeting guide RNA
gucuugagggccuugugcuucu

SEQ ID NO: 1665 - RNA, 22 nt, Artificial Sequence
  CXCR4 targeting guide RNA
gugcuucugguggcccuuggag

SEQ ID NO: 1666 - RNA, 22 nt, Artificial Sequence
  CXCR4 targeting guide RNA
guggucuugagggccuugugcu

SEQ ID NO: 1667 - RNA, 22 nt, Artificial Sequence
  CXCR4 targeting guide RNA
ucacacuccaagggccaccaga

SEQ ID NO: 1668 - RNA, 22 nt, Artificial Sequence
  CXCR4 targeting guide RNA
uccaagggccaccagaagcaca

SEQ ID NO: 1669 - RNA, 22 nt, Artificial Sequence
  CXCR4 targeting guide RNA
ucuugagggccuugugcuucug

SEQ ID NO: 1670 - RNA, 22 nt, Artificial Sequence
  CXCR4 targeting guide RNA
ugacuguggucuugagggccuu

SEQ ID NO: 1671 - RNA, 22 nt, Artificial Sequence
  CXCR4 targeting guide RNA
ugagggccuugugcuucuggug

SEQ ID NO: 1672 - RNA, 22 nt, Artificial Sequence
  CXCR4 targeting guide RNA
ugcuucugguggcccuuggagu

SEQ ID NO: 1673 - RNA, 22 nt, Artificial Sequence
  CXCR4 targeting guide RNA
uggucuugagggccuugugcuu

SEQ ID NO: 1674 - RNA, 22 nt, Artificial Sequence
  CXCR4 targeting guide RNA
ugugcuucugguggcccuugga

SEQ ID NO: 1675 - RNA, 22 nt, Artificial Sequence
  CXCR4 targeting guide RNA
uguggucuugagggccuugugc

SEQ ID NO: 1676 - RNA, 22 nt, Artificial Sequence
  CXCR4 targeting guide RNA
uugagggccuugugcuucuggu

SEQ ID NO: 1677 - RNA, 22 nt, Artificial Sequence
  CXCR4 targeting guide RNA
uugugcuucugguggcccuugg

SEQ ID NO: 1678 - RNA, 20 nt, Artificial Sequence
  CXCR4 targeting guide RNA
aaacuggaacacaaccaccc

SEQ ID NO: 1679 - RNA, 20 nt, Artificial Sequence
  CXCR4 targeting guide RNA
aacacaaccacccagaaguc

SEQ ID NO: 1680 - RNA, 20 nt, Artificial Sequence
  CXCR4 targeting guide RNA
aaccacccagaagucauugg

SEQ ID NO: 1681 - RNA, 20 nt, Artificial Sequence
  CXCR4 targeting guide RNA
aacuggaacacaaccaccca

SEQ ID NO: 1682 - RNA, 20 nt, Artificial Sequence
  CXCR4 targeting guide RNA
aaugacuucugggugguugu

SEQ ID NO: 1683 - RNA, 20 nt, Artificial Sequence
  CXCR4 targeting guide RNA
acaaccacccagaagucauu

SEQ ID NO: 1684 - RNA, 20 nt, Artificial Sequence
  CXCR4 targeting guide RNA
acacaaccacccagaaguca

SEQ ID NO: 1685 - RNA, 20 nt, Artificial Sequence
  CXCR4 targeting guide RNA
accacccagaagucauuggg

SEQ ID NO: 1686 - RNA, 20 nt, Artificial Sequence
  CXCR4 targeting guide RNA
acccagaagucauuggggua

SEQ ID NO: 1687 - RNA, 20 nt, Artificial Sequence
  CXCR4 targeting guide RNA
accccaaugacuucugggug

SEQ ID NO: 1688 - RNA, 20 nt, Artificial Sequence
  CXCR4 targeting guide RNA
accgcuucuaccccaaugac

SEQ ID NO: 1689 - RNA, 20 nt, Artificial Sequence
  CXCR4 targeting guide RNA
acuggaacacaaccacccag

SEQ ID NO: 1690 - RNA, 20 nt, Artificial Sequence
  CXCR4 targeting guide RNA
acuucugggugguuguguuc

SEQ ID NO: 1691 - RNA, 20 nt, Artificial Sequence
  CXCR4 targeting guide RNA
agaagucauugggguagaag

SEQ ID NO: 1692 - RNA, 20 nt, Artificial Sequence
  CXCR4 targeting guide RNA
augacuucugggugguugug

SEQ ID NO: 1693 - RNA, 20 nt, Artificial Sequence
  CXCR4 targeting guide RNA
caaccacccagaagucauug

SEQ ID NO: 1694 - RNA, 20 nt, Artificial Sequence
  CXCR4 targeting guide RNA
caaugacuucugggugguug

SEQ ID NO: 1695 - RNA, 20 nt, Artificial Sequence
  CXCR4 targeting guide RNA
cacaaccacccagaagucau

SEQ ID NO: 1696 - RNA, 20 nt, Artificial Sequence
  CXCR4 targeting guide RNA
cacccagaagucauuggggu

SEQ ID NO: 1697 - RNA, 20 nt, Artificial Sequence
  CXCR4 targeting guide RNA
cagaagucauugggguagaa

SEQ ID NO: 1698 - RNA, 20 nt, Artificial Sequence
  CXCR4 targeting guide RNA
ccaaugacuucugggugguu

SEQ ID NO: 1699 - RNA, 20 nt, Artificial Sequence
  CXCR4 targeting guide RNA
ccacccagaagucauugggg

SEQ ID NO: 1700 - RNA, 20 nt, Artificial Sequence
  CXCR4 targeting guide RNA
ccagaagucauugggguaga

SEQ ID NO: 1701 - RNA, 20 nt, Artificial Sequence
  CXCR4 targeting guide RNA
cccaaugacuucuggguggu

SEQ ID NO: 1702 - RNA, 20 nt, Artificial Sequence
  CXCR4 targeting guide RNA
cccagaagucauugggguag

SEQ ID NO: 1703 - RNA, 20 nt, Artificial Sequence
  CXCR4 targeting guide RNA
ccccaaugacuucugggugg

SEQ ID NO: 1704 - RNA, 20 nt, Artificial Sequence
  CXCR4 targeting guide RNA
ccgcuucuaccccaaugacu

SEQ ID NO: 1705 - RNA, 20 nt, Artificial Sequence
  CXCR4 targeting guide RNA
cgcuucuaccccaaugacuu

SEQ ID NO: 1706 - RNA, 20 nt, Artificial Sequence
  CXCR4 targeting guide RNA
cuaccccaaugacuucuggg

SEQ ID NO: 1707 - RNA, 20 nt, Artificial Sequence
  CXCR4 targeting guide RNA
cuggaacacaaccacccaga

SEQ ID NO: 1708 - RNA, 20 nt, Artificial Sequence
  CXCR4 targeting guide RNA
cuucuaccccaaugacuucu

SEQ ID NO: 1709 - RNA, 20 nt, Artificial Sequence
  CXCR4 targeting guide RNA
cuucugggugguuguguucc

SEQ ID NO: 1710 - RNA, 20 nt, Artificial Sequence
  CXCR4 targeting guide RNA
gaaacuggaacacaaccacc

SEQ ID NO: 1711 - RNA, 20 nt, Artificial Sequence
  CXCR4 targeting guide RNA
gaacacaaccacccagaagu

SEQ ID NO: 1712 - RNA, 20 nt, Artificial Sequence
  CXCR4 targeting guide RNA
gaagucauugggguagaagc

SEQ ID NO: 1713 - RNA, 20 nt, Artificial Sequence
  CXCR4 targeting guide RNA
gaccgcuucuaccccaauga

SEQ ID NO: 1714 - RNA, 20 nt, Artificial Sequence
  CXCR4 targeting guide RNA
gacuucugggugguuguguu

SEQ ID NO: 1715 - RNA, 20 nt, Artificial Sequence
  CXCR4 targeting guide RNA
gcuucuaccccaaugacuuc

SEQ ID NO: 1716 - RNA, 20 nt, Artificial Sequence
  CXCR4 targeting guide RNA
ggaacacaaccacccagaag

SEQ ID NO: 1717 - RNA, 20 nt, Artificial Sequence
  CXCR4 targeting guide RNA
uaccccaaugacuucugggu

SEQ ID NO: 1718 - RNA, 20 nt, Artificial Sequence
  CXCR4 targeting guide RNA
ucuaccccaaugacuucugg

SEQ ID NO: 1719 - RNA, 20 nt, Artificial Sequence
  CXCR4 targeting guide RNA
ucugggugguuguguuccag

SEQ ID NO: 1720 - RNA, 20 nt, Artificial Sequence
  CXCR4 targeting guide RNA
ugacuucugggugguugugu

SEQ ID NO: 1721 - RNA, 20 nt, Artificial Sequence
  CXCR4 targeting guide RNA
uggaacacaaccacccagaa

SEQ ID NO: 1722 - RNA, 20 nt, Artificial Sequence
  CXCR4 targeting guide RNA
uucuaccccaaugacuucug

SEQ ID NO: 1723 - RNA, 20 nt, Artificial Sequence
  CXCR4 targeting guide RNA
uucugggugguuguguucca

SEQ ID NO: 1724 - RNA, 21 nt, Artificial Sequence
  CXCR4 targeting guide RNA
aaacuggaacacaaccaccca

SEQ ID NO: 1725 - RNA, 21 nt, Artificial Sequence
  CXCR4 targeting guide RNA
aacacaaccacccagaaguca

SEQ ID NO: 1726 - RNA, 21 nt, Artificial Sequence
  CXCR4 targeting guide RNA
aaccacccagaagucauuggg

SEQ ID NO: 1727 - RNA, 21 nt, Artificial Sequence
  CXCR4 targeting guide RNA
aacuggaacacaaccacccag

SEQ ID NO: 1728 - RNA, 21 nt, Artificial Sequence
  CXCR4 targeting guide RNA
aaugacuucugggugguugug

SEQ ID NO: 1729 - RNA, 21 nt, Artificial Sequence
  CXCR4 targeting guide RNA
acaaccacccagaagucauug

SEQ ID NO: 1730 - RNA, 21 nt, Artificial Sequence
  CXCR4 targeting guide RNA
acacaaccacccagaagucau

SEQ ID NO: 1731 - RNA, 21 nt, Artificial Sequence
  CXCR4 targeting guide RNA
accacccagaagucauugggg

SEQ ID NO: 1732 - RNA, 21 nt, Artificial Sequence
  CXCR4 targeting guide RNA
acccagaagucauugggguag

SEQ ID NO: 1733 - RNA, 21 nt, Artificial Sequence
  CXCR4 targeting guide RNA
accccaaugacuucugggugg

SEQ ID NO: 1734 - RNA, 21 nt, Artificial Sequence
  CXCR4 targeting guide RNA
accgcuucuaccccaaugacu

SEQ ID NO: 1735 - RNA, 21 nt, Artificial Sequence
  CXCR4 targeting guide RNA
acuggaacacaaccacccaga

SEQ ID NO: 1736 - RNA, 21 nt, Artificial Sequence
  CXCR4 targeting guide RNA
acuucugggugguuguguucc

SEQ ID NO: 1737 - RNA, 21 nt, Artificial Sequence
  CXCR4 targeting guide RNA
agaagucauugggguagaagc

SEQ ID NO: 1738 - RNA, 21 nt, Artificial Sequence
  CXCR4 targeting guide RNA
augacuucugggugguugugu

SEQ ID NO: 1739 - RNA, 21 nt, Artificial Sequence
  CXCR4 targeting guide RNA
caaccacccagaagucauugg

SEQ ID NO: 1740 - RNA, 21 nt, Artificial Sequence
  CXCR4 targeting guide RNA
caaugacuucugggugguugu

SEQ ID NO: 1741 - RNA, 21 nt, Artificial Sequence
  CXCR4 targeting guide RNA
cacaaccacccagaagucauu

SEQ ID NO: 1742 - RNA, 21 nt, Artificial Sequence
  CXCR4 targeting guide RNA
cacccagaagucauuggggua

SEQ ID NO: 1743 - RNA, 21 nt, Artificial Sequence
  CXCR4 targeting guide RNA
cagaagucauugggguagaag

SEQ ID NO: 1744 - RNA, 21 nt, Artificial Sequence
  CXCR4 targeting guide RNA
ccaaugacuucugggugguug

SEQ ID NO: 1745 - RNA, 21 nt, Artificial Sequence
  CXCR4 targeting guide RNA
ccacccagaagucauuggggu

SEQ ID NO: 1746 - RNA, 21 nt, Artificial Sequence
  CXCR4 targeting guide RNA
ccagaagucauugggguagaa

SEQ ID NO: 1747 - RNA, 21 nt, Artificial Sequence
  CXCR4 targeting guide RNA
cccaaugacuucugggugguu

SEQ ID NO: 1748 - RNA, 21 nt, Artificial Sequence
  CXCR4 targeting guide RNA
cccagaagucauugggguaga

SEQ ID NO: 1749 - RNA, 21 nt, Artificial Sequence
  CXCR4 targeting guide RNA
ccccaaugacuucuggguggu

SEQ ID NO: 1750 - RNA, 21 nt, Artificial Sequence
  CXCR4 targeting guide RNA
ccgcuucuaccccaaugacuu

SEQ ID NO: 1751 - RNA, 21 nt, Artificial Sequence
  CXCR4 targeting guide RNA
cgcuucuaccccaaugacuuc

SEQ ID NO: 1752 - RNA, 21 nt, Artificial Sequence
  CXCR4 targeting guide RNA
cuaccccaaugacuucugggu

SEQ ID NO: 1753 - RNA, 21 nt, Artificial Sequence
  CXCR4 targeting guide RNA
cuggaacacaaccacccagaa

SEQ ID NO: 1754 - RNA, 21 nt, Artificial Sequence
  CXCR4 targeting guide RNA
cuucuaccccaaugacuucug

SEQ ID NO: 1755 - RNA, 21 nt, Artificial Sequence
  CXCR4 targeting guide RNA
cuucugggugguuguguucca

SEQ ID NO: 1756 - RNA, 21 nt, Artificial Sequence
  CXCR4 targeting guide RNA
gaaacuggaacacaaccaccc

SEQ ID NO: 1757 - RNA, 21 nt, Artificial Sequence
  CXCR4 targeting guide RNA
gaacacaaccacccagaaguc

SEQ ID NO: 1758 - RNA, 21 nt, Artificial Sequence
  CXCR4 targeting guide RNA
gaagucauugggguagaagcg

SEQ ID NO: 1759 - RNA, 21 nt, Artificial Sequence
  CXCR4 targeting guide RNA
gaccgcuucuaccccaaugac

SEQ ID NO: 1760 - RNA, 21 nt, Artificial Sequence
  CXCR4 targeting guide RNA
gacuucugggugguuguguuc

SEQ ID NO: 1761 - RNA, 21 nt, Artificial Sequence
  CXCR4 targeting guide RNA
gcuucuaccccaaugacuucu

SEQ ID NO: 1762 - RNA, 21 nt, Artificial Sequence
  CXCR4 targeting guide RNA
ggaacacaaccacccagaagu

SEQ ID NO: 1763 - RNA, 21 nt, Artificial Sequence
  CXCR4 targeting guide RNA
uaccccaaugacuucugggug

SEQ ID NO: 1764 - RNA, 21 nt, Artificial Sequence
  CXCR4 targeting guide RNA
ucuaccccaaugacuucuggg

SEQ ID NO: 1765 - RNA, 21 nt, Artificial Sequence
  CXCR4 targeting guide RNA
ucugggugguuguguuccagu

SEQ ID NO: 1766 - RNA, 21 nt, Artificial Sequence
  CXCR4 targeting guide RNA
ugaaacuggaacacaaccacc

SEQ ID NO: 1767 - RNA, 21 nt, Artificial Sequence
  CXCR4 targeting guide RNA
ugaccgcuucuaccccaauga

SEQ ID NO: 1768 - RNA, 21 nt, Artificial Sequence
  CXCR4 targeting guide RNA
ugacuucugggugguuguguu

SEQ ID NO: 1769 - RNA, 21 nt, Artificial Sequence
  CXCR4 targeting guide RNA
uggaacacaaccacccagaag

SEQ ID NO: 1770 - RNA, 21 nt, Artificial Sequence
  CXCR4 targeting guide RNA
uucuaccccaaugacuucugg

SEQ ID NO: 1771 - RNA, 21 nt, Artificial Sequence
  CXCR4 targeting guide RNA
uucugggugguuguguuccag

SEQ ID NO: 1772 - RNA, 22 nt, Artificial Sequence
  CXCR4 targeting guide RNA
aaacuggaacacaaccacccag

SEQ ID NO: 1773 - RNA, 22 nt, Artificial Sequence
  CXCR4 targeting guide RNA
aacacaaccacccagaagucau

SEQ ID NO: 1774 - RNA, 22 nt, Artificial Sequence
  CXCR4 targeting guide RNA
aaccacccagaagucauugggg

SEQ ID NO: 1775 - RNA, 22 nt, Artificial Sequence
  CXCR4 targeting guide RNA
aacuggaacacaaccacccaga

SEQ ID NO: 1776 - RNA, 22 nt, Artificial Sequence
  CXCR4 targeting guide RNA
aaugacuucugggugguugugu

SEQ ID NO: 1777 - RNA, 22 nt, Artificial Sequence
  CXCR4 targeting guide RNA
acaaccacccagaagucauugg

SEQ ID NO: 1778 - RNA, 22 nt, Artificial Sequence
  CXCR4 targeting guide RNA
acacaaccacccagaagucauu

SEQ ID NO: 1779 - RNA, 22 nt, Artificial Sequence
  CXCR4 targeting guide RNA
accacccagaagucauuggggu

SEQ ID NO: 1780 - RNA, 22 nt, Artificial Sequence
  CXCR4 targeting guide RNA
acccagaagucauugggguaga

SEQ ID NO: 1781 - RNA, 22 nt, Artificial Sequence
  CXCR4 targeting guide RNA
accccaaugacuucuggguggu

SEQ ID NO: 1782 - RNA, 22 nt, Artificial Sequence
  CXCR4 targeting guide RNA
accgcuucuaccccaaugacuu

SEQ ID NO: 1783 - RNA, 22 nt, Artificial Sequence
  CXCR4 targeting guide RNA
acuggaacacaaccacccagaa

SEQ ID NO: 1784 - RNA, 22 nt, Artificial Sequence
  CXCR4 targeting guide RNA
acuucugggugguuguguucca

SEQ ID NO: 1785 - RNA, 22 nt, Artificial Sequence
  CXCR4 targeting guide RNA
agaagucauugggguagaagcg

SEQ ID NO: 1786 - RNA, 22 nt, Artificial Sequence
  CXCR4 targeting guide RNA
augacuucugggugguuguguu

SEQ ID NO: 1787 - RNA, 22 nt, Artificial Sequence
  CXCR4 targeting guide RNA
caaccacccagaagucauuggg

SEQ ID NO: 1788 - RNA, 22 nt, Artificial Sequence
  CXCR4 targeting guide RNA
caaugacuucugggugguugug

SEQ ID NO: 1789 - RNA, 22 nt, Artificial Sequence
  CXCR4 targeting guide RNA
cacaaccacccagaagucauug

SEQ ID NO: 1790 - RNA, 22 nt, Artificial Sequence
  CXCR4 targeting guide RNA
cacccagaagucauugggguag

SEQ ID NO: 1791 - RNA, 22 nt, Artificial Sequence
  CXCR4 targeting guide RNA
cagaagucauugggguagaagc

SEQ ID NO: 1792 - RNA, 22 nt, Artificial Sequence
  CXCR4 targeting guide RNA
ccaaugacuucugggugguugu

SEQ ID NO: 1793 - RNA, 22 nt, Artificial Sequence
  CXCR4 targeting guide RNA
ccacccagaagucauuggggua

SEQ ID NO: 1794 - RNA, 22 nt, Artificial Sequence
  CXCR4 targeting guide RNA
ccagaagucauugggguagaag

SEQ ID NO: 1795 - RNA, 22 nt, Artificial Sequence
  CXCR4 targeting guide RNA
cccaaugacuucugggugguug

SEQ ID NO: 1796 - RNA, 22 nt, Artificial Sequence
  CXCR4 targeting guide RNA
cccagaagucauugggguagaa

SEQ ID NO: 1797 - RNA, 22 nt, Artificial Sequence
  CXCR4 targeting guide RNA
ccccaaugacuucugggugguu

SEQ ID NO: 1798 - RNA, 22 nt, Artificial Sequence
  CXCR4 targeting guide RNA
ccgcuucuaccccaaugacuuc

SEQ ID NO: 1799 - RNA, 22 nt, Artificial Sequence
  CXCR4 targeting guide RNA
cgcuucuaccccaaugacuucu

SEQ ID NO: 1800 - RNA, 22 nt, Artificial Sequence
  CXCR4 targeting guide RNA
cuaccccaaugacuucugggug

SEQ ID NO: 1801 - RNA, 22 nt, Artificial Sequence
  CXCR4 targeting guide RNA
cugaaacuggaacacaaccacc

SEQ ID NO: 1802 - RNA, 22 nt, Artificial Sequence
  CXCR4 targeting guide RNA
cuggaacacaaccacccagaag

SEQ ID NO: 1803 - RNA, 22 nt, Artificial Sequence
  CXCR4 targeting guide RNA
cuucuaccccaaugacuucugg

SEQ ID NO: 1804 - RNA, 22 nt, Artificial Sequence
  CXCR4 targeting guide RNA
cuucugggugguuguguuccag

SEQ ID NO: 1805 - RNA, 22 nt, Artificial Sequence
  CXCR4 targeting guide RNA
gaaacuggaacacaaccaccca

SEQ ID NO: 1806 - RNA, 22 nt, Artificial Sequence
  CXCR4 targeting guide RNA
gaacacaaccacccagaaguca

SEQ ID NO: 1807 - RNA, 22 nt, Artificial Sequence
  CXCR4 targeting guide RNA
gaagucauugggguagaagcgg

SEQ ID NO: 1808 - RNA, 22 nt, Artificial Sequence
  CXCR4 targeting guide RNA
gaccgcuucuaccccaaugacu

SEQ ID NO: 1809 - RNA, 22 nt, Artificial Sequence
  CXCR4 targeting guide RNA
gacuucugggugguuguguucc

SEQ ID NO: 1810 - RNA, 22 nt, Artificial Sequence
  CXCR4 targeting guide RNA
gcuucuaccccaaugacuucug

SEQ ID NO: 1811 - RNA, 22 nt, Artificial Sequence
  CXCR4 targeting guide RNA
ggaacacaaccacccagaaguc

SEQ ID NO: 1812 - RNA, 22 nt, Artificial Sequence
  CXCR4 targeting guide RNA
gugaccgcuucuaccccaauga

SEQ ID NO: 1813 - RNA, 22 nt, Artificial Sequence
  CXCR4 targeting guide RNA
uaccccaaugacuucugggugg

SEQ ID NO: 1814 - RNA, 22 nt, Artificial Sequence
  CXCR4 targeting guide RNA
ucuaccccaaugacuucugggu

SEQ ID NO: 1815 - RNA, 22 nt, Artificial Sequence
  CXCR4 targeting guide RNA
ucugggugguuguguuccaguu

SEQ ID NO: 1816 - RNA, 22 nt, Artificial Sequence
  CXCR4 targeting guide RNA
ugaaacuggaacacaaccaccc

SEQ ID NO: 1817 - RNA, 22 nt, Artificial Sequence
  CXCR4 targeting guide RNA
ugaccgcuucuaccccaaugac

SEQ ID NO: 1818 - RNA, 22 nt, Artificial Sequence
  CXCR4 targeting guide RNA
ugacuucugggugguuguguuc

SEQ ID NO: 1819 - RNA, 22 nt, Artificial Sequence
  CXCR4 targeting guide RNA
uggaacacaaccacccagaagu

SEQ ID NO: 1820 - RNA, 22 nt, Artificial Sequence
  CXCR4 targeting guide RNA
uucuaccccaaugacuucuggg

SEQ ID NO: 1821 - RNA, 22 nt, Artificial Sequence
  CXCR4 targeting guide RNA
uucugggugguuguguuccagu

SEQ ID NO: 1822 - RNA, 20 nt, Artificial Sequence
  CXCR4 targeting guide RNA
aaagaugaagucgggaguag

SEQ ID NO: 1823 - RNA, 20 nt, Artificial Sequence
  CXCR4 targeting guide RNA
aagaugaagucgggaguagu

SEQ ID NO: 1824 - RNA, 20 nt, Artificial Sequence
  CXCR4 targeting guide RNA
aagucgggaguagucagcag

SEQ ID NO: 1825 - RNA, 20 nt, Artificial Sequence
  CXCR4 targeting guide RNA
acuacucccgacuucaucuu

SEQ ID NO: 1826 - RNA, 20 nt, Artificial Sequence
  CXCR4 targeting guide RNA
acucccgacuucaucuuugc

SEQ ID NO: 1827 - RNA, 20 nt, Artificial Sequence
  CXCR4 targeting guide RNA
agaugaagucgggaguaguc

SEQ ID NO: 1828 - RNA, 20 nt, Artificial Sequence
  CXCR4 targeting guide RNA
aguagucagcaggagggcag

SEQ ID NO: 1829 - RNA, 20 nt, Artificial Sequence
  CXCR4 targeting guide RNA
agucgggaguagucagcagg

SEQ ID NO: 1830 - RNA, 20 nt, Artificial Sequence
  CXCR4 targeting guide RNA
aucccugcccuccugcugac

SEQ ID NO: 1831 - RNA, 20 nt, Artificial Sequence
  CXCR4 targeting guide RNA
augaagucgggaguagucag

SEQ ID NO: 1832 - RNA, 20 nt, Artificial Sequence
  CXCR4 targeting guide RNA
caaagaugaagucgggagua

SEQ ID NO: 1833 - RNA, 20 nt, Artificial Sequence
  CXCR4 targeting guide RNA
cccuccugcugacuacuccc

SEQ ID NO: 1834 - RNA, 20 nt, Artificial Sequence
  CXCR4 targeting guide RNA
cccugcccuccugcugacua

SEQ ID NO: 1835 - RNA, 20 nt, Artificial Sequence
  CXCR4 targeting guide RNA
ccuccugcugacuacucccg

SEQ ID NO: 1836 - RNA, 20 nt, Artificial Sequence
  CXCR4 targeting guide RNA
ccugcccuccugcugacuac

SEQ ID NO: 1837 - RNA, 20 nt, Artificial Sequence
  CXCR4 targeting guide RNA
ccugcugacuacucccgacu

SEQ ID NO: 1838 - RNA, 20 nt, Artificial Sequence
  CXCR4 targeting guide RNA
cgggaguagucagcaggagg

SEQ ID NO: 1839 - RNA, 20 nt, Artificial Sequence
  CXCR4 targeting guide RNA
cuacucccgacuucaucuuu

SEQ ID NO: 1840 - RNA, 20 nt, Artificial Sequence
  CXCR4 targeting guide RNA
cuccugcugacuacucccga

SEQ ID NO: 1841 - RNA, 20 nt, Artificial Sequence
  CXCR4 targeting guide RNA
cugacuacucccgacuucau

SEQ ID NO: 1842 - RNA, 20 nt, Artificial Sequence
  CXCR4 targeting guide RNA
cugcccuccugcugacuacu

SEQ ID NO: 1843 - RNA, 20 nt, Artificial Sequence
  CXCR4 targeting guide RNA
cugcugacuacucccgacuu

SEQ ID NO: 1844 - RNA, 20 nt, Artificial Sequence
  CXCR4 targeting guide RNA
gaagucgggaguagucagca

SEQ ID NO: 1845 - RNA, 20 nt, Artificial Sequence
  CXCR4 targeting guide RNA
gacuacucccgacuucaucu

SEQ ID NO: 1846 - RNA, 20 nt, Artificial Sequence
  CXCR4 targeting guide RNA
gaguagucagcaggagggca

SEQ ID NO: 1847 - RNA, 20 nt, Artificial Sequence
  CXCR4 targeting guide RNA
gaucccugcccuccugcuga

SEQ ID NO: 1848 - RNA, 20 nt, Artificial Sequence
  CXCR4 targeting guide RNA
gaugaagucgggaguaguca

SEQ ID NO: 1849 - RNA, 20 nt, Artificial Sequence
  CXCR4 targeting guide RNA
gcaaagaugaagucgggagu

SEQ ID NO: 1850 - RNA, 20 nt, Artificial Sequence
  CXCR4 targeting guide RNA
gcccuccugcugacuacucc

SEQ ID NO: 1851 - RNA, 20 nt, Artificial Sequence
  CXCR4 targeting guide RNA
gcugacuacucccgacuuca

SEQ ID NO: 1852 - RNA, 20 nt, Artificial Sequence
  CXCR4 targeting guide RNA
ggaguagucagcaggagggc

SEQ ID NO: 1853 - RNA, 20 nt, Artificial Sequence
  CXCR4 targeting guide RNA
ggcaaagaugaagucgggag

SEQ ID NO: 1854 - RNA, 20 nt, Artificial Sequence
  CXCR4 targeting guide RNA
gggaguagucagcaggaggg

SEQ ID NO: 1855 - RNA, 20 nt, Artificial Sequence
  CXCR4 targeting guide RNA
guagucagcaggagggcagg

SEQ ID NO: 1856 - RNA, 20 nt, Artificial Sequence
  CXCR4 targeting guide RNA
gucgggaguagucagcagga

SEQ ID NO: 1857 - RNA, 20 nt, Artificial Sequence
  CXCR4 targeting guide RNA
guuggcaaagaugaagucgg

SEQ ID NO: 1858 - RNA, 20 nt, Artificial Sequence
  CXCR4 targeting guide RNA
uacucccgacuucaucuuug

SEQ ID NO: 1859 - RNA, 20 nt, Artificial Sequence
  CXCR4 targeting guide RNA
ucccugcccuccugcugacu

SEQ ID NO: 1860 - RNA, 20 nt, Artificial Sequence
  CXCR4 targeting guide RNA
uccugcugacuacucccgac

SEQ ID NO: 1861 - RNA, 20 nt, Artificial Sequence
  CXCR4 targeting guide RNA
ucgggaguagucagcaggag

SEQ ID NO: 1862 - RNA, 20 nt, Artificial Sequence
  CXCR4 targeting guide RNA
ugaagucgggaguagucagc

SEQ ID NO: 1863 - RNA, 20 nt, Artificial Sequence
  CXCR4 targeting guide RNA
ugacuacucccgacuucauc

SEQ ID NO: 1864 - RNA, 20 nt, Artificial Sequence
  CXCR4 targeting guide RNA
ugcccuccugcugacuacuc

SEQ ID NO: 1865 - RNA, 20 nt, Artificial Sequence
  CXCR4 targeting guide RNA
ugcugacuacucccgacuuc

SEQ ID NO: 1866 - RNA, 20 nt, Artificial Sequence
  CXCR4 targeting guide RNA
uggcaaagaugaagucggga

SEQ ID NO: 1867 - RNA, 20 nt, Artificial Sequence
  CXCR4 targeting guide RNA
uuggcaaagaugaagucggg

SEQ ID NO: 1868 - RNA, 21 nt, Artificial Sequence
  CXCR4 targeting guide RNA
aaagaugaagucgggaguagu

SEQ ID NO: 1869 - RNA, 21 nt, Artificial Sequence
  CXCR4 targeting guide RNA
aagaugaagucgggaguaguc

SEQ ID NO: 1870 - RNA, 21 nt, Artificial Sequence
  CXCR4 targeting guide RNA
aagucgggaguagucagcagg

SEQ ID NO: 1871 - RNA, 21 nt, Artificial Sequence
  CXCR4 targeting guide RNA
acuacucccgacuucaucuuu

SEQ ID NO: 1872 - RNA, 21 nt, Artificial Sequence
  CXCR4 targeting guide RNA
acucccgacuucaucuuugcc

SEQ ID NO: 1873 - RNA, 21 nt, Artificial Sequence
  CXCR4 targeting guide RNA
agaugaagucgggaguaguca

SEQ ID NO: 1874 - RNA, 21 nt, Artificial Sequence
  CXCR4 targeting guide RNA
aguagucagcaggagggcagg

SEQ ID NO: 1875 - RNA, 21 nt, Artificial Sequence
  CXCR4 targeting guide RNA
agucgggaguagucagcagga

SEQ ID NO: 1876 - RNA, 21 nt, Artificial Sequence
  CXCR4 targeting guide RNA
aucccugcccuccugcugacu

SEQ ID NO: 1877 - RNA, 21 nt, Artificial Sequence
  CXCR4 targeting guide RNA
augaagucgggaguagucagc

SEQ ID NO: 1878 - RNA, 21 nt, Artificial Sequence
  CXCR4 targeting guide RNA
caaagaugaagucgggaguag

SEQ ID NO: 1879 - RNA, 21 nt, Artificial Sequence
  CXCR4 targeting guide RNA
cccuccugcugacuacucccg

SEQ ID NO: 1880 - RNA, 21 nt, Artificial Sequence
  CXCR4 targeting guide RNA
cccugcccuccugcugacuac

SEQ ID NO: 1881 - RNA, 21 nt, Artificial Sequence
  CXCR4 targeting guide RNA
ccuccugcugacuacucccga

SEQ ID NO: 1882 - RNA, 21 nt, Artificial Sequence
  CXCR4 targeting guide RNA
ccugcccuccugcugacuacu

SEQ ID NO: 1883 - RNA, 21 nt, Artificial Sequence
  CXCR4 targeting guide RNA
ccugcugacuacucccgacuu

SEQ ID NO: 1884 - RNA, 21 nt, Artificial Sequence
  CXCR4 targeting guide RNA
cgggaguagucagcaggaggg

SEQ ID NO: 1885 - RNA, 21 nt, Artificial Sequence
  CXCR4 targeting guide RNA
cguuggcaaagaugaagucgg

SEQ ID NO: 1886 - RNA, 21 nt, Artificial Sequence
  CXCR4 targeting guide RNA
cuacucccgacuucaucuuug

SEQ ID NO: 1887 - RNA, 21 nt, Artificial Sequence
  CXCR4 targeting guide RNA
cuccugcugacuacucccgac

SEQ ID NO: 1888 - RNA, 21 nt, Artificial Sequence
  CXCR4 targeting guide RNA
cugacuacucccgacuucauc

SEQ ID NO: 1889 - RNA, 21 nt, Artificial Sequence
  CXCR4 targeting guide RNA
cugcccuccugcugacuacuc

SEQ ID NO: 1890 - RNA, 21 nt, Artificial Sequence
  CXCR4 targeting guide RNA
cugcugacuacucccgacuuc

SEQ ID NO: 1891 - RNA, 21 nt, Artificial Sequence
  CXCR4 targeting guide RNA
gaagucgggaguagucagcag

SEQ ID NO: 1892 - RNA, 21 nt, Artificial Sequence
  CXCR4 targeting guide RNA
gacuacucccgacuucaucuu

SEQ ID NO: 1893 - RNA, 21 nt, Artificial Sequence
  CXCR4 targeting guide RNA
gaguagucagcaggagggcag

SEQ ID NO: 1894 - RNA, 21 nt, Artificial Sequence
  CXCR4 targeting guide RNA
gaucccugcccuccugcugac

SEQ ID NO: 1895 - RNA, 21 nt, Artificial Sequence
  CXCR4 targeting guide RNA
gaugaagucgggaguagucag

SEQ ID NO: 1896 - RNA, 21 nt, Artificial Sequence
  CXCR4 targeting guide RNA
gcaaagaugaagucgggagua

SEQ ID NO: 1897 - RNA, 21 nt, Artificial Sequence
  CXCR4 targeting guide RNA
gcccuccugcugacuacuccc

SEQ ID NO: 1898 - RNA, 21 nt, Artificial Sequence
  CXCR4 targeting guide RNA
gcugacuacucccgacuucau

SEQ ID NO: 1899 - RNA, 21 nt, Artificial Sequence
  CXCR4 targeting guide RNA
ggaguagucagcaggagggca

SEQ ID NO: 1900 - RNA, 21 nt, Artificial Sequence
  CXCR4 targeting guide RNA
ggaucccugcccuccugcuga

SEQ ID NO: 1901 - RNA, 21 nt, Artificial Sequence
  CXCR4 targeting guide RNA
ggcaaagaugaagucgggagu

SEQ ID NO: 1902 - RNA, 21 nt, Artificial Sequence
  CXCR4 targeting guide RNA
gggaguagucagcaggagggc

SEQ ID NO: 1903 - RNA, 21 nt, Artificial Sequence
  CXCR4 targeting guide RNA
guagucagcaggagggcaggg

SEQ ID NO: 1904 - RNA, 21 nt, Artificial Sequence
  CXCR4 targeting guide RNA
gucgggaguagucagcaggag

SEQ ID NO: 1905 - RNA, 21 nt, Artificial Sequence
  CXCR4 targeting guide RNA
guuggcaaagaugaagucggg

SEQ ID NO: 1906 - RNA, 21 nt, Artificial Sequence
  CXCR4 targeting guide RNA
uacucccgacuucaucuuugc

SEQ ID NO: 1907 - RNA, 21 nt, Artificial Sequence
  CXCR4 targeting guide RNA
ucccugcccuccugcugacua

SEQ ID NO: 1908 - RNA, 21 nt, Artificial Sequence
  CXCR4 targeting guide RNA
uccugcugacuacucccgacu

SEQ ID NO: 1909 - RNA, 21 nt, Artificial Sequence
  CXCR4 targeting guide RNA
ucgggaguagucagcaggagg

SEQ ID NO: 1910 - RNA, 21 nt, Artificial Sequence
  CXCR4 targeting guide RNA
ugaagucgggaguagucagca

SEQ ID NO: 1911 - RNA, 21 nt, Artificial Sequence
  CXCR4 targeting guide RNA
ugacuacucccgacuucaucu

SEQ ID NO: 1912 - RNA, 21 nt, Artificial Sequence
  CXCR4 targeting guide RNA
ugcccuccugcugacuacucc

SEQ ID NO: 1913 - RNA, 21 nt, Artificial Sequence
  CXCR4 targeting guide RNA
ugcugacuacucccgacuuca

SEQ ID NO: 1914 - RNA, 21 nt, Artificial Sequence
  CXCR4 targeting guide RNA
uggcaaagaugaagucgggag

SEQ ID NO: 1915 - RNA, 21 nt, Artificial Sequence
  CXCR4 targeting guide RNA
uuggcaaagaugaagucggga

SEQ ID NO: 1916 - RNA, 22 nt, Artificial Sequence
  CXCR4 targeting guide RNA
aaagaugaagucgggaguaguc

SEQ ID NO: 1917 - RNA, 22 nt, Artificial Sequence
  CXCR4 targeting guide RNA
aagaugaagucgggaguaguca

SEQ ID NO: 1918 - RNA, 22 nt, Artificial Sequence
  CXCR4 targeting guide RNA
aagucgggaguagucagcagga

SEQ ID NO: 1919 - RNA, 22 nt, Artificial Sequence
  CXCR4 targeting guide RNA
acguuggcaaagaugaagucgg

SEQ ID NO: 1920 - RNA, 22 nt, Artificial Sequence
  CXCR4 targeting guide RNA
acuacucccgacuucaucuuug

SEQ ID NO: 1921 - RNA, 22 nt, Artificial Sequence
  CXCR4 targeting guide RNA
acucccgacuucaucuuugcca

SEQ ID NO: 1922 - RNA, 22 nt, Artificial Sequence
  CXCR4 targeting guide RNA
agaugaagucgggaguagucag

SEQ ID NO: 1923 - RNA, 22 nt, Artificial Sequence
  CXCR4 targeting guide RNA
aguagucagcaggagggcaggg

SEQ ID NO: 1924 - RNA, 22 nt, Artificial Sequence
  CXCR4 targeting guide RNA
agucgggaguagucagcaggag

SEQ ID NO: 1925 - RNA, 22 nt, Artificial Sequence
  CXCR4 targeting guide RNA
aucccugcccuccugcugacua

SEQ ID NO: 1926 - RNA, 22 nt, Artificial Sequence
  CXCR4 targeting guide RNA
augaagucgggaguagucagca

SEQ ID NO: 1927 - RNA, 22 nt, Artificial Sequence
  CXCR4 targeting guide RNA
caaagaugaagucgggaguagu

SEQ ID NO: 1928 - RNA, 22 nt, Artificial Sequence
  CXCR4 targeting guide RNA
cccuccugcugacuacucccga

SEQ ID NO: 1929 - RNA, 22 nt, Artificial Sequence
  CXCR4 targeting guide RNA
cccugcccuccugcugacuacu

SEQ ID NO: 1930 - RNA, 22 nt, Artificial Sequence
  CXCR4 targeting guide RNA
ccuccugcugacuacucccgac

SEQ ID NO: 1931 - RNA, 22 nt, Artificial Sequence
  CXCR4 targeting guide RNA
ccugcccuccugcugacuacuc

SEQ ID NO: 1932 - RNA, 22 nt, Artificial Sequence
  CXCR4 targeting guide RNA
ccugcugacuacucccgacuuc

SEQ ID NO: 1933 - RNA, 22 nt, Artificial Sequence
  CXCR4 targeting guide RNA
cgggaguagucagcaggagggc

SEQ ID NO: 1934 - RNA, 22 nt, Artificial Sequence
  CXCR4 targeting guide RNA
cguuggcaaagaugaagucggg

SEQ ID NO: 1935 - RNA, 22 nt, Artificial Sequence
  CXCR4 targeting guide RNA
cuacucccgacuucaucuuugc

SEQ ID NO: 1936 - RNA, 22 nt, Artificial Sequence
  CXCR4 targeting guide RNA
cuccugcugacuacucccgacu

SEQ ID NO: 1937 - RNA, 22 nt, Artificial Sequence
  CXCR4 targeting guide RNA
cugacuacucccgacuucaucu

SEQ ID NO: 1938 - RNA, 22 nt, Artificial Sequence
  CXCR4 targeting guide RNA
cugcccuccugcugacuacucc

SEQ ID NO: 1939 - RNA, 22 nt, Artificial Sequence
  CXCR4 targeting guide RNA
cugcugacuacucccgacuuca

SEQ ID NO: 1940 - RNA, 22 nt, Artificial Sequence
  CXCR4 targeting guide RNA
gaagucgggaguagucagcagg

SEQ ID NO: 1941 - RNA, 22 nt, Artificial Sequence
  CXCR4 targeting guide RNA
gacuacucccgacuucaucuuu

SEQ ID NO: 1942 - RNA, 22 nt, Artificial Sequence
  CXCR4 targeting guide RNA
gaguagucagcaggagggcagg

SEQ ID NO: 1943 - RNA, 22 nt, Artificial Sequence
  CXCR4 targeting guide RNA
gaucccugcccuccugcugacu

SEQ ID NO: 1944 - RNA, 22 nt, Artificial Sequence
  CXCR4 targeting guide RNA
gaugaagucgggaguagucagc

SEQ ID NO: 1945 - RNA, 22 nt, Artificial Sequence
  CXCR4 targeting guide RNA
gcaaagaugaagucgggaguag

SEQ ID NO: 1946 - RNA, 22 nt, Artificial Sequence
  CXCR4 targeting guide RNA
gcccuccugcugacuacucccg

SEQ ID NO: 1947 - RNA, 22 nt, Artificial Sequence
  CXCR4 targeting guide RNA
gcugacuacucccgacuucauc

SEQ ID NO: 1948 - RNA, 22 nt, Artificial Sequence
  CXCR4 targeting guide RNA
ggaguagucagcaggagggcag

SEQ ID NO: 1949 - RNA, 22 nt, Artificial Sequence
  CXCR4 targeting guide RNA
ggaucccugcccuccugcugac

SEQ ID NO: 1950 - RNA, 22 nt, Artificial Sequence
  CXCR4 targeting guide RNA
ggcaaagaugaagucgggagua

SEQ ID NO: 1951 - RNA, 22 nt, Artificial Sequence
  CXCR4 targeting guide RNA
gggaguagucagcaggagggca

SEQ ID NO: 1952 - RNA, 22 nt, Artificial Sequence
  CXCR4 targeting guide RNA
guagucagcaggagggcaggga

SEQ ID NO: 1953 - RNA, 22 nt, Artificial Sequence
  CXCR4 targeting guide RNA
gucgggaguagucagcaggagg

SEQ ID NO: 1954 - RNA, 22 nt, Artificial Sequence
  CXCR4 targeting guide RNA
guuggcaaagaugaagucggga

SEQ ID NO: 1955 - RNA, 22 nt, Artificial Sequence
  CXCR4 targeting guide RNA
uacucccgacuucaucuuugcc

SEQ ID NO: 1956 - RNA, 22 nt, Artificial Sequence
  CXCR4 targeting guide RNA
ucccugcccuccugcugacuac

SEQ ID NO: 1957 - RNA, 22 nt, Artificial Sequence
  CXCR4 targeting guide RNA
uccugcugacuacucccgacuu

SEQ ID NO: 1958 - RNA, 22 nt, Artificial Sequence
  CXCR4 targeting guide RNA
ucgggaguagucagcaggaggg

SEQ ID NO: 1959 - RNA, 22 nt, Artificial Sequence
  CXCR4 targeting guide RNA
ugaagucgggaguagucagcag

SEQ ID NO: 1960 - RNA, 22 nt, Artificial Sequence
  CXCR4 targeting guide RNA
ugacuacucccgacuucaucuu

SEQ ID NO: 1961 - RNA, 22 nt, Artificial Sequence
  CXCR4 targeting guide RNA
ugcccuccugcugacuacuccc

SEQ ID NO: 1962 - RNA, 22 nt, Artificial Sequence
  CXCR4 targeting guide RNA
ugcugacuacucccgacuucau

SEQ ID NO: 1963 - RNA, 22 nt, Artificial Sequence
  CXCR4 targeting guide RNA
uggaucccugcccuccugcuga

SEQ ID NO: 1964 - RNA, 22 nt, Artificial Sequence
  CXCR4 targeting guide RNA
uggcaaagaugaagucgggagu

SEQ ID NO: 1965 - RNA, 22 nt, Artificial Sequence
  CXCR4 targeting guide RNA
uuggcaaagaugaagucgggag

SEQ ID NO: 1966 - RNA, 20 nt, Artificial Sequence
  CXCR4 targeting guide RNA
aaaagguggucuauguuggc

SEQ ID NO: 1967 - RNA, 20 nt, Artificial Sequence
  CXCR4 targeting guide RNA
aaagguggucuauguuggca

SEQ ID NO: 1968 - RNA, 20 nt, Artificial Sequence
  CXCR4 targeting guide RNA
aagguggucuauguuggcau

SEQ ID NO: 1969 - RNA, 20 nt, Artificial Sequence
  CXCR4 targeting guide RNA
agaugccaacauagaccacc

SEQ ID NO: 1970 - RNA, 20 nt, Artificial Sequence
  CXCR4 targeting guide RNA
agcaggagggcagggaucca

SEQ ID NO: 1971 - RNA, 20 nt, Artificial Sequence
  CXCR4 targeting guide RNA
aggagggcagggauccagau

SEQ ID NO: 1972 - RNA, 20 nt, Artificial Sequence
  CXCR4 targeting guide RNA
agggauccagaugccaacau

SEQ ID NO: 1973 - RNA, 20 nt, Artificial Sequence
  CXCR4 targeting guide RNA
agggcagggauccagaugcc

SEQ ID NO: 1974 - RNA, 20 nt, Artificial Sequence
  CXCR4 targeting guide RNA
agguggucuauguuggcauc

SEQ ID NO: 1975 - RNA, 20 nt, Artificial Sequence
  CXCR4 targeting guide RNA
auccagaugccaacauagac

SEQ ID NO: 1976 - RNA, 20 nt, Artificial Sequence
  CXCR4 targeting guide RNA
augccaacauagaccaccuu

SEQ ID NO: 1977 - RNA, 20 nt, Artificial Sequence
  CXCR4 targeting guide RNA
auguuggcaucuggaucccu

SEQ ID NO: 1978 - RNA, 20 nt, Artificial Sequence
  CXCR4 targeting guide RNA
cagaugccaacauagaccac

SEQ ID NO: 1979 - RNA, 20 nt, Artificial Sequence
  CXCR4 targeting guide RNA
caggagggcagggauccaga

SEQ ID NO: 1980 - RNA, 20 nt, Artificial Sequence
  CXCR4 targeting guide RNA
cagggauccagaugccaaca

SEQ ID NO: 1981 - RNA, 20 nt, Artificial Sequence
  CXCR4 targeting guide RNA
caucuggaucccugcccucc

SEQ ID NO: 1982 - RNA, 20 nt, Artificial Sequence
  CXCR4 targeting guide RNA
ccagaugccaacauagacca

SEQ ID NO: 1983 - RNA, 20 nt, Artificial Sequence
  CXCR4 targeting guide RNA
cuauguuggcaucuggaucc

SEQ ID NO: 1984 - RNA, 20 nt, Artificial Sequence
  CXCR4 targeting guide RNA
cugaaaagguggucuauguu

SEQ ID NO: 1985 - RNA, 20 nt, Artificial Sequence
  CXCR4 targeting guide RNA
gaaaagguggucuauguugg

SEQ ID NO: 1986 - RNA, 20 nt, Artificial Sequence
  CXCR4 targeting guide RNA
gagggcagggauccagaugc

SEQ ID NO: 1987 - RNA, 20 nt, Artificial Sequence
  CXCR4 targeting guide RNA
gauccagaugccaacauaga

SEQ ID NO: 1988 - RNA, 20 nt, Artificial Sequence
  CXCR4 targeting guide RNA
gaugccaacauagaccaccu

SEQ ID NO: 1989 - RNA, 20 nt, Artificial Sequence
  CXCR4 targeting guide RNA
gcaggagggcagggauccag

SEQ ID NO: 1990 - RNA, 20 nt, Artificial Sequence
  CXCR4 targeting guide RNA
gcagggauccagaugccaac

SEQ ID NO: 1991 - RNA, 20 nt, Artificial Sequence
  CXCR4 targeting guide RNA
gcaucuggaucccugcccuc

SEQ ID NO: 1992 - RNA, 20 nt, Artificial Sequence
  CXCR4 targeting guide RNA
ggagggcagggauccagaug

SEQ ID NO: 1993 - RNA, 20 nt, Artificial Sequence
  CXCR4 targeting guide RNA
ggauccagaugccaacauag

SEQ ID NO: 1994 - RNA, 20 nt, Artificial Sequence
  CXCR4 targeting guide RNA
ggcagggauccagaugccaa

SEQ ID NO: 1995 - RNA, 20 nt, Artificial Sequence
  CXCR4 targeting guide RNA
ggcaucuggaucccugcccu

SEQ ID NO: 1996 - RNA, 20 nt, Artificial Sequence
  CXCR4 targeting guide RNA
gggauccagaugccaacaua

SEQ ID NO: 1997 - RNA, 20 nt, Artificial Sequence
  CXCR4 targeting guide RNA
gggcagggauccagaugcca

SEQ ID NO: 1998 - RNA, 20 nt, Artificial Sequence
  CXCR4 targeting guide RNA
ggucuauguuggcaucugga

SEQ ID NO: 1999 - RNA, 20 nt, Artificial Sequence
  CXCR4 targeting guide RNA
gguggucuauguuggcaucu

SEQ ID NO: 2000 - RNA, 20 nt, Artificial Sequence
  CXCR4 targeting guide RNA
gucuauguuggcaucuggau

SEQ ID NO: 2001 - RNA, 20 nt, Artificial Sequence
  CXCR4 targeting guide RNA
guggucuauguuggcaucug

SEQ ID NO: 2002 - RNA, 20 nt, Artificial Sequence
  CXCR4 targeting guide RNA
guuggcaucuggaucccugc

SEQ ID NO: 2003 - RNA, 20 nt, Artificial Sequence
  CXCR4 targeting guide RNA
uauguuggcaucuggauccc

SEQ ID NO: 2004 - RNA, 20 nt, Artificial Sequence
  CXCR4 targeting guide RNA
uccagaugccaacauagacc

SEQ ID NO: 2005 - RNA, 20 nt, Artificial Sequence
  CXCR4 targeting guide RNA
ucuauguuggcaucuggauc

SEQ ID NO: 2006 - RNA, 20 nt, Artificial Sequence
  CXCR4 targeting guide RNA
ugaaaagguggucuauguug

SEQ ID NO: 2007 - RNA, 20 nt, Artificial Sequence
  CXCR4 targeting guide RNA
ugccaacauagaccaccuuu

SEQ ID NO: 2008 - RNA, 20 nt, Artificial Sequence
  CXCR4 targeting guide RNA
uggcaucuggaucccugccc

SEQ ID NO: 2009 - RNA, 20 nt, Artificial Sequence
  CXCR4 targeting guide RNA
uggucuauguuggcaucugg

SEQ ID NO: 2010 - RNA, 20 nt, Artificial Sequence
  CXCR4 targeting guide RNA
uguuggcaucuggaucccug

SEQ ID NO: 2011 - RNA, 20 nt, Artificial Sequence
  CXCR4 targeting guide RNA
uuggcaucuggaucccugcc

SEQ ID NO: 2012 - RNA, 21 nt, Artificial Sequence
  CXCR4 targeting guide RNA
aaaagguggucuauguuggca

SEQ ID NO: 2013 - RNA, 21 nt, Artificial Sequence
  CXCR4 targeting guide RNA
aaagguggucuauguuggcau

SEQ ID NO: 2014 - RNA, 21 nt, Artificial Sequence
  CXCR4 targeting guide RNA
aagguggucuauguuggcauc

SEQ ID NO: 2015 - RNA, 21 nt, Artificial Sequence
  CXCR4 targeting guide RNA
agaugccaacauagaccaccu

SEQ ID NO: 2016 - RNA, 21 nt, Artificial Sequence
  CXCR4 targeting guide RNA
agcaggagggcagggauccag

SEQ ID NO: 2017 - RNA, 21 nt, Artificial Sequence
  CXCR4 targeting guide RNA
aggagggcagggauccagaug

SEQ ID NO: 2018 - RNA, 21 nt, Artificial Sequence
  CXCR4 targeting guide RNA
agggauccagaugccaacaua

SEQ ID NO: 2019 - RNA, 21 nt, Artificial Sequence
  CXCR4 targeting guide RNA
agggcagggauccagaugcca

SEQ ID NO: 2020 - RNA, 21 nt, Artificial Sequence
  CXCR4 targeting guide RNA
agguggucuauguuggcaucu

SEQ ID NO: 2021 - RNA, 21 nt, Artificial Sequence
  CXCR4 targeting guide RNA
auccagaugccaacauagacc

SEQ ID NO: 2022 - RNA, 21 nt, Artificial Sequence
  CXCR4 targeting guide RNA
augccaacauagaccaccuuu

SEQ ID NO: 2023 - RNA, 21 nt, Artificial Sequence
  CXCR4 targeting guide RNA
auguuggcaucuggaucccug

SEQ ID NO: 2024 - RNA, 21 nt, Artificial Sequence
  CXCR4 targeting guide RNA
cagaugccaacauagaccacc

SEQ ID NO: 2025 - RNA, 21 nt, Artificial Sequence
  CXCR4 targeting guide RNA
cagcaggagggcagggaucca

SEQ ID NO: 2026 - RNA, 21 nt, Artificial Sequence
  CXCR4 targeting guide RNA
caggagggcagggauccagau

SEQ ID NO: 2027 - RNA, 21 nt, Artificial Sequence
  CXCR4 targeting guide RNA
cagggauccagaugccaacau

SEQ ID NO: 2028 - RNA, 21 nt, Artificial Sequence
  CXCR4 targeting guide RNA
caucuggaucccugcccuccu

SEQ ID NO: 2029 - RNA, 21 nt, Artificial Sequence
  CXCR4 targeting guide RNA
ccagaugccaacauagaccac

SEQ ID NO: 2030 - RNA, 21 nt, Artificial Sequence
  CXCR4 targeting guide RNA
cuauguuggcaucuggauccc

SEQ ID NO: 2031 - RNA, 21 nt, Artificial Sequence
  CXCR4 targeting guide RNA
cugaaaagguggucuauguug

SEQ ID NO: 2032 - RNA, 21 nt, Artificial Sequence
  CXCR4 targeting guide RNA
gaaaagguggucuauguuggc

SEQ ID NO: 2033 - RNA, 21 nt, Artificial Sequence
  CXCR4 targeting guide RNA
gagggcagggauccagaugcc

SEQ ID NO: 2034 - RNA, 21 nt, Artificial Sequence
  CXCR4 targeting guide RNA
gauccagaugccaacauagac

SEQ ID NO: 2035 - RNA, 21 nt, Artificial Sequence
  CXCR4 targeting guide RNA
gaugccaacauagaccaccuu

SEQ ID NO: 2036 - RNA, 21 nt, Artificial Sequence
  CXCR4 targeting guide RNA
gcaggagggcagggauccaga

SEQ ID NO: 2037 - RNA, 21 nt, Artificial Sequence
  CXCR4 targeting guide RNA
gcagggauccagaugccaaca

SEQ ID NO: 2038 - RNA, 21 nt, Artificial Sequence
  CXCR4 targeting guide RNA
gcaucuggaucccugcccucc

SEQ ID NO: 2039 - RNA, 21 nt, Artificial Sequence
  CXCR4 targeting guide RNA
gcugaaaagguggucuauguu

SEQ ID NO: 2040 - RNA, 21 nt, Artificial Sequence
  CXCR4 targeting guide RNA
ggagggcagggauccagaugc

SEQ ID NO: 2041 - RNA, 21 nt, Artificial Sequence
  CXCR4 targeting guide RNA
ggauccagaugccaacauaga

SEQ ID NO: 2042 - RNA, 21 nt, Artificial Sequence
  CXCR4 targeting guide RNA
ggcagggauccagaugccaac

SEQ ID NO: 2043 - RNA, 21 nt, Artificial Sequence
  CXCR4 targeting guide RNA
ggcaucuggaucccugcccuc

SEQ ID NO: 2044 - RNA, 21 nt, Artificial Sequence
  CXCR4 targeting guide RNA
gggauccagaugccaacauag

SEQ ID NO: 2045 - RNA, 21 nt, Artificial Sequence
  CXCR4 targeting guide RNA
gggcagggauccagaugccaa

SEQ ID NO: 2046 - RNA, 21 nt, Artificial Sequence
  CXCR4 targeting guide RNA
ggucuauguuggcaucuggau

SEQ ID NO: 2047 - RNA, 21 nt, Artificial Sequence
  CXCR4 targeting guide RNA
gguggucuauguuggcaucug

SEQ ID NO: 2048 - RNA, 21 nt, Artificial Sequence
  CXCR4 targeting guide RNA
gucuauguuggcaucuggauc

SEQ ID NO: 2049 - RNA, 21 nt, Artificial Sequence
  CXCR4 targeting guide RNA
guggucuauguuggcaucugg

SEQ ID NO: 2050 - RNA, 21 nt, Artificial Sequence
  CXCR4 targeting guide RNA
guuggcaucuggaucccugcc

SEQ ID NO: 2051 - RNA, 21 nt, Artificial Sequence
  CXCR4 targeting guide RNA
uauguuggcaucuggaucccu

SEQ ID NO: 2052 - RNA, 21 nt, Artificial Sequence
  CXCR4 targeting guide RNA
uccagaugccaacauagacca

SEQ ID NO: 2053 - RNA, 21 nt, Artificial Sequence
  CXCR4 targeting guide RNA
ucuauguuggcaucuggaucc

SEQ ID NO: 2054 - RNA, 21 nt, Artificial Sequence
  CXCR4 targeting guide RNA
ugaaaagguggucuauguugg

SEQ ID NO: 2055 - RNA, 21 nt, Artificial Sequence
  CXCR4 targeting guide RNA
ugccaacauagaccaccuuuu

SEQ ID NO: 2056 - RNA, 21 nt, Artificial Sequence
  CXCR4 targeting guide RNA
uggcaucuggaucccugcccu

SEQ ID NO: 2057 - RNA, 21 nt, Artificial Sequence
  CXCR4 targeting guide RNA
uggucuauguuggcaucugga

SEQ ID NO: 2058 - RNA, 21 nt, Artificial Sequence
  CXCR4 targeting guide RNA
uguuggcaucuggaucccugc

SEQ ID NO: 2059 - RNA, 21 nt, Artificial Sequence
  CXCR4 targeting guide RNA
uuggcaucuggaucccugccc

SEQ ID NO: 2060 - RNA, 22 nt, Artificial Sequence
  CXCR4 targeting guide RNA
aaaagguggucuauguuggcau

SEQ ID NO: 2061 - RNA, 22 nt, Artificial Sequence
  CXCR4 targeting guide RNA
aaagguggucuauguuggcauc

SEQ ID NO: 2062 - RNA, 22 nt, Artificial Sequence
  CXCR4 targeting guide RNA
aagguggucuauguuggcaucu

SEQ ID NO: 2063 - RNA, 22 nt, Artificial Sequence
  CXCR4 targeting guide RNA
agaugccaacauagaccaccuu

SEQ ID NO: 2064 - RNA, 22 nt, Artificial Sequence
  CXCR4 targeting guide RNA
agcaggagggcagggauccaga

SEQ ID NO: 2065 - RNA, 22 nt, Artificial Sequence
  CXCR4 targeting guide RNA
aggagggcagggauccagaugc

SEQ ID NO: 2066 - RNA, 22 nt, Artificial Sequence
  CXCR4 targeting guide RNA
agggauccagaugccaacauag

SEQ ID NO: 2067 - RNA, 22 nt, Artificial Sequence
  CXCR4 targeting guide RNA
agggcagggauccagaugccaa

SEQ ID NO: 2068 - RNA, 22 nt, Artificial Sequence
  CXCR4 targeting guide RNA
agguggucuauguuggcaucug

SEQ ID NO: 2069 - RNA, 22 nt, Artificial Sequence
  CXCR4 targeting guide RNA
auccagaugccaacauagacca

SEQ ID NO: 2070 - RNA, 22 nt, Artificial Sequence
  CXCR4 targeting guide RNA
augccaacauagaccaccuuuu

SEQ ID NO: 2071 - RNA, 22 nt, Artificial Sequence
  CXCR4 targeting guide RNA
auguuggcaucuggaucccugc

SEQ ID NO: 2072 - RNA, 22 nt, Artificial Sequence
  CXCR4 targeting guide RNA
cagaugccaacauagaccaccu

SEQ ID NO: 2073 - RNA, 22 nt, Artificial Sequence
  CXCR4 targeting guide RNA
cagcaggagggcagggauccag

SEQ ID NO: 2074 - RNA, 22 nt, Artificial Sequence
  CXCR4 targeting guide RNA
caggagggcagggauccagaug

SEQ ID NO: 2075 - RNA, 22 nt, Artificial Sequence
  CXCR4 targeting guide RNA
cagggauccagaugccaacaua

SEQ ID NO: 2076 - RNA, 22 nt, Artificial Sequence
  CXCR4 targeting guide RNA
caucuggaucccugcccuccug

SEQ ID NO: 2077 - RNA, 22 nt, Artificial Sequence
  CXCR4 targeting guide RNA
ccagaugccaacauagaccacc

SEQ ID NO: 2078 - RNA, 22 nt, Artificial Sequence
  CXCR4 targeting guide RNA
cuauguuggcaucuggaucccu

SEQ ID NO: 2079 - RNA, 22 nt, Artificial Sequence
  CXCR4 targeting guide RNA
cugaaaagguggucuauguugg

SEQ ID NO: 2080 - RNA, 22 nt, Artificial Sequence
  CXCR4 targeting guide RNA
gaaaagguggucuauguuggca

SEQ ID NO: 2081 - RNA, 22 nt, Artificial Sequence
  CXCR4 targeting guide RNA
gagggcagggauccagaugcca

SEQ ID NO: 2082 - RNA, 22 nt, Artificial Sequence
  CXCR4 targeting guide RNA
gauccagaugccaacauagacc

SEQ ID NO: 2083 - RNA, 22 nt, Artificial Sequence
  CXCR4 targeting guide RNA
gaugccaacauagaccaccuuu

SEQ ID NO: 2084 - RNA, 22 nt, Artificial Sequence
  CXCR4 targeting guide RNA
gcaggagggcagggauccagau

SEQ ID NO: 2085 - RNA, 22 nt, Artificial Sequence
  CXCR4 targeting guide RNA
gcagggauccagaugccaacau

SEQ ID NO: 2086 - RNA, 22 nt, Artificial Sequence
  CXCR4 targeting guide RNA
gcaucuggaucccugcccuccu

SEQ ID NO: 2087 - RNA, 22 nt, Artificial Sequence
  CXCR4 targeting guide RNA
gcugaaaagguggucuauguug

SEQ ID NO: 2088 - RNA, 22 nt, Artificial Sequence
  CXCR4 targeting guide RNA
ggagggcagggauccagaugcc

SEQ ID NO: 2089 - RNA, 22 nt, Artificial Sequence
  CXCR4 targeting guide RNA
ggauccagaugccaacauagac

SEQ ID NO: 2090 - RNA, 22 nt, Artificial Sequence
  CXCR4 targeting guide RNA
ggcagggauccagaugccaaca

SEQ ID NO: 2091 - RNA, 22 nt, Artificial Sequence
  CXCR4 targeting guide RNA
ggcaucuggaucccugcccucc

SEQ ID NO: 2092 - RNA, 22 nt, Artificial Sequence
  CXCR4 targeting guide RNA
ggcugaaaagguggucuauguu

SEQ ID NO: 2093 - RNA, 22 nt, Artificial Sequence
  CXCR4 targeting guide RNA
gggauccagaugccaacauaga

SEQ ID NO: 2094 - RNA, 22 nt, Artificial Sequence
  CXCR4 targeting guide RNA
gggcagggauccagaugccaac

SEQ ID NO: 2095 - RNA, 22 nt, Artificial Sequence
  CXCR4 targeting guide RNA
ggucuauguuggcaucuggauc

SEQ ID NO: 2096 - RNA, 22 nt, Artificial Sequence
  CXCR4 targeting guide RNA
gguggucuauguuggcaucugg

SEQ ID NO: 2097 - RNA, 22 nt, Artificial Sequence
  CXCR4 targeting guide RNA
gucuauguuggcaucuggaucc

SEQ ID NO: 2098 - RNA, 22 nt, Artificial Sequence
  CXCR4 targeting guide RNA
guggucuauguuggcaucugga

SEQ ID NO: 2099 - RNA, 22 nt, Artificial Sequence
  CXCR4 targeting guide RNA
guuggcaucuggaucccugccc

SEQ ID NO: 2100 - RNA, 22 nt, Artificial Sequence
  CXCR4 targeting guide RNA
uauguuggcaucuggaucccug

SEQ ID NO: 2101 - RNA, 22 nt, Artificial Sequence
  CXCR4 targeting guide RNA
ucagcaggagggcagggaucca

SEQ ID NO: 2102 - RNA, 22 nt, Artificial Sequence
  CXCR4 targeting guide RNA
uccagaugccaacauagaccac

SEQ ID NO: 2103 - RNA, 22 nt, Artificial Sequence
  CXCR4 targeting guide RNA
ucuauguuggcaucuggauccc

SEQ ID NO: 2104 - RNA, 22 nt, Artificial Sequence
  CXCR4 targeting guide RNA
ugaaaagguggucuauguuggc

SEQ ID NO: 2105 - RNA, 22 nt, Artificial Sequence
  CXCR4 targeting guide RNA
ugccaacauagaccaccuuuuc

SEQ ID NO: 2106 - RNA, 22 nt, Artificial Sequence
  CXCR4 targeting guide RNA
uggcaucuggaucccugcccuc

SEQ ID NO: 2107 - RNA, 22 nt, Artificial Sequence
  CXCR4 targeting guide RNA
uggucuauguuggcaucuggau

SEQ ID NO: 2108 - RNA, 22 nt, Artificial Sequence
  CXCR4 targeting guide RNA
uguuggcaucuggaucccugcc

SEQ ID NO: 2109 - RNA, 22 nt, Artificial Sequence
  CXCR4 targeting guide RNA
uuggcaucuggaucccugcccu

SEQ ID NO: 2110 - RNA, 20 nt, Artificial Sequence
  CXCR4 targeting guide RNA
aacauagaccaccuuugcag

SEQ ID NO: 2111 - RNA, 20 nt, Artificial Sequence
  CXCR4 targeting guide RNA
aagcuguuggcugcaaaggu

SEQ ID NO: 2112 - RNA, 20 nt, Artificial Sequence
  CXCR4 targeting guide RNA
aaggaagcuguuggcugcaa

SEQ ID NO: 2113 - RNA, 20 nt, Artificial Sequence
  CXCR4 targeting guide RNA
acauagaccaccuuugcagc

SEQ ID NO: 2114 - RNA, 20 nt, Artificial Sequence
  CXCR4 targeting guide RNA
accaccuuugcagccaacag

SEQ ID NO: 2115 - RNA, 20 nt, Artificial Sequence
  CXCR4 targeting guide RNA
accuuugcagccaacagcuu

SEQ ID NO: 2116 - RNA, 20 nt, Artificial Sequence
  CXCR4 targeting guide RNA
acgccaacauagaccaccuu

SEQ ID NO: 2117 - RNA, 20 nt, Artificial Sequence
  CXCR4 targeting guide RNA
agaccaccuuugcagccaac

SEQ ID NO: 2118 - RNA, 20 nt, Artificial Sequence
  CXCR4 targeting guide RNA
agcuguuggcugcaaaggug

SEQ ID NO: 2119 - RNA, 20 nt, Artificial Sequence
  CXCR4 targeting guide RNA
aggaagcuguuggcugcaaa

SEQ ID NO: 2120 - RNA, 20 nt, Artificial Sequence
  CXCR4 targeting guide RNA
aggccaaggaagcuguuggc

SEQ ID NO: 2121 - RNA, 20 nt, Artificial Sequence
  CXCR4 targeting guide RNA
auagaccaccuuugcagcca

SEQ ID NO: 2122 - RNA, 20 nt, Artificial Sequence
  CXCR4 targeting guide RNA
caacauagaccaccuuugca

SEQ ID NO: 2123 - RNA, 20 nt, Artificial Sequence
  CXCR4 targeting guide RNA
caaggaagcuguuggcugca

SEQ ID NO: 2124 - RNA, 20 nt, Artificial Sequence
  CXCR4 targeting guide RNA
caccuuugcagccaacagcu

SEQ ID NO: 2125 - RNA, 20 nt, Artificial Sequence
  CXCR4 targeting guide RNA
cauagaccaccuuugcagcc

SEQ ID NO: 2126 - RNA, 20 nt, Artificial Sequence
  CXCR4 targeting guide RNA
ccaacauagaccaccuuugc

SEQ ID NO: 2127 - RNA, 20 nt, Artificial Sequence
  CXCR4 targeting guide RNA
ccaaggaagcuguuggcugc

SEQ ID NO: 2128 - RNA, 20 nt, Artificial Sequence
  CXCR4 targeting guide RNA
ccaccuuugcagccaacagc

SEQ ID NO: 2129 - RNA, 20 nt, Artificial Sequence
  CXCR4 targeting guide RNA
ccuuugcagccaacagcuuc

SEQ ID NO: 2130 - RNA, 20 nt, Artificial Sequence
  CXCR4 targeting guide RNA
cgccaacauagaccaccuuu

SEQ ID NO: 2131 - RNA, 20 nt, Artificial Sequence
  CXCR4 targeting guide RNA
cugcaaagguggucuauguu

SEQ ID NO: 2132 - RNA, 20 nt, Artificial Sequence
  CXCR4 targeting guide RNA
cuguuggcugcaaagguggu

SEQ ID NO: 2133 - RNA, 20 nt, Artificial Sequence
  CXCR4 targeting guide RNA
cuuugcagccaacagcuucc

SEQ ID NO: 2134 - RNA, 20 nt, Artificial Sequence
  CXCR4 targeting guide RNA
gaagcuguuggcugcaaagg

SEQ ID NO: 2135 - RNA, 20 nt, Artificial Sequence
  CXCR4 targeting guide RNA
gaccaccuuugcagccaaca

SEQ ID NO: 2136 - RNA, 20 nt, Artificial Sequence
  CXCR4 targeting guide RNA
gacgccaacauagaccaccu

SEQ ID NO: 2137 - RNA, 20 nt, Artificial Sequence
  CXCR4 targeting guide RNA
gaggccaaggaagcuguugg

SEQ ID NO: 2138 - RNA, 20 nt, Artificial Sequence
  CXCR4 targeting guide RNA
gcaaagguggucuauguugg

SEQ ID NO: 2139 - RNA, 20 nt, Artificial Sequence
  CXCR4 targeting guide RNA
gcagccaacagcuuccuugg

SEQ ID NO: 2140 - RNA, 20 nt, Artificial Sequence
  CXCR4 targeting guide RNA
gccaacauagaccaccuuug

SEQ ID NO: 2141 - RNA, 20 nt, Artificial Sequence
  CXCR4 targeting guide RNA
gccaaggaagcuguuggcug

SEQ ID NO: 2142 - RNA, 20 nt, Artificial Sequence
  CXCR4 targeting guide RNA
gcugcaaagguggucuaugu

SEQ ID NO: 2143 - RNA, 20 nt, Artificial Sequence
  CXCR4 targeting guide RNA
gcuguuggcugcaaaggugg

SEQ ID NO: 2144 - RNA, 20 nt, Artificial Sequence
  CXCR4 targeting guide RNA
ggaagcuguuggcugcaaag

SEQ ID NO: 2145 - RNA, 20 nt, Artificial Sequence
  CXCR4 targeting guide RNA
ggccaaggaagcuguuggcu

SEQ ID NO: 2146 - RNA, 20 nt, Artificial Sequence
  CXCR4 targeting guide RNA
ggcugcaaagguggucuaug

SEQ ID NO: 2147 - RNA, 20 nt, Artificial Sequence
  CXCR4 targeting guide RNA
guuggcugcaaagguggucu

SEQ ID NO: 2148 - RNA, 20 nt, Artificial Sequence
  CXCR4 targeting guide RNA
uagaccaccuuugcagccaa

SEQ ID NO: 2149 - RNA, 20 nt, Artificial Sequence
  CXCR4 targeting guide RNA
ugcaaagguggucuauguug

SEQ ID NO: 2150 - RNA, 20 nt, Artificial Sequence
  CXCR4 targeting guide RNA
ugcagccaacagcuuccuug

SEQ ID NO: 2151 - RNA, 20 nt, Artificial Sequence
  CXCR4 targeting guide RNA
uggcugcaaagguggucuau

SEQ ID NO: 2152 - RNA, 20 nt, Artificial Sequence
  CXCR4 targeting guide RNA
uguuggcugcaaaggugguc

SEQ ID NO: 2153 - RNA, 20 nt, Artificial Sequence
  CXCR4 targeting guide RNA
uugcagccaacagcuuccuu

SEQ ID NO: 2154 - RNA, 20 nt, Artificial Sequence
  CXCR4 targeting guide RNA
uuggcugcaaagguggucua

SEQ ID NO: 2155 - RNA, 20 nt, Artificial Sequence
  CXCR4 targeting guide RNA
uuugcagccaacagcuuccu

SEQ ID NO: 2156 - RNA, 21 nt, Artificial Sequence
  CXCR4 targeting guide RNA
aacauagaccaccuuugcagc

SEQ ID NO: 2157 - RNA, 21 nt, Artificial Sequence
  CXCR4 targeting guide RNA
aagcuguuggcugcaaaggug

SEQ ID NO: 2158 - RNA, 21 nt, Artificial Sequence
  CXCR4 targeting guide RNA
aaggaagcuguuggcugcaaa

SEQ ID NO: 2159 - RNA, 21 nt, Artificial Sequence
  CXCR4 targeting guide RNA
acauagaccaccuuugcagcc

SEQ ID NO: 2160 - RNA, 21 nt, Artificial Sequence
  CXCR4 targeting guide RNA
accaccuuugcagccaacagc

SEQ ID NO: 2161 - RNA, 21 nt, Artificial Sequence
  CXCR4 targeting guide RNA
accuuugcagccaacagcuuc

SEQ ID NO: 2162 - RNA, 21 nt, Artificial Sequence
  CXCR4 targeting guide RNA
acgccaacauagaccaccuuu

SEQ ID NO: 2163 - RNA, 21 nt, Artificial Sequence
  CXCR4 targeting guide RNA
agaccaccuuugcagccaaca

SEQ ID NO: 2164 - RNA, 21 nt, Artificial Sequence
  CXCR4 targeting guide RNA
agacgccaacauagaccaccu

SEQ ID NO: 2165 - RNA, 21 nt, Artificial Sequence
  CXCR4 targeting guide RNA
agaggccaaggaagcuguugg

SEQ ID NO: 2166 - RNA, 21 nt, Artificial Sequence
  CXCR4 targeting guide RNA
agcuguuggcugcaaaggugg

SEQ ID NO: 2167 - RNA, 21 nt, Artificial Sequence
  CXCR4 targeting guide RNA
aggaagcuguuggcugcaaag

SEQ ID NO: 2168 - RNA, 21 nt, Artificial Sequence
  CXCR4 targeting guide RNA
aggccaaggaagcuguuggcu

SEQ ID NO: 2169 - RNA, 21 nt, Artificial Sequence
  CXCR4 targeting guide RNA
auagaccaccuuugcagccaa

SEQ ID NO: 2170 - RNA, 21 nt, Artificial Sequence
  CXCR4 targeting guide RNA
caacauagaccaccuuugcag

SEQ ID NO: 2171 - RNA, 21 nt, Artificial Sequence
  CXCR4 targeting guide RNA
caaggaagcuguuggcugcaa

SEQ ID NO: 2172 - RNA, 21 nt, Artificial Sequence
  CXCR4 targeting guide RNA
caccuuugcagccaacagcuu

SEQ ID NO: 2173 - RNA, 21 nt, Artificial Sequence
  CXCR4 targeting guide RNA
cauagaccaccuuugcagcca

SEQ ID NO: 2174 - RNA, 21 nt, Artificial Sequence
  CXCR4 targeting guide RNA
ccaacauagaccaccuuugca

SEQ ID NO: 2175 - RNA, 21 nt, Artificial Sequence
  CXCR4 targeting guide RNA
ccaaggaagcuguuggcugca

SEQ ID NO: 2176 - RNA, 21 nt, Artificial Sequence
  CXCR4 targeting guide RNA
ccaccuuugcagccaacagcu

SEQ ID NO: 2177 - RNA, 21 nt, Artificial Sequence
  CXCR4 targeting guide RNA
ccuuugcagccaacagcuucc

SEQ ID NO: 2178 - RNA, 21 nt, Artificial Sequence
  CXCR4 targeting guide RNA
cgccaacauagaccaccuuug

SEQ ID NO: 2179 - RNA, 21 nt, Artificial Sequence
  CXCR4 targeting guide RNA
cugcaaagguggucuauguug

SEQ ID NO: 2180 - RNA, 21 nt, Artificial Sequence
  CXCR4 targeting guide RNA
cuguuggcugcaaaggugguc

SEQ ID NO: 2181 - RNA, 21 nt, Artificial Sequence
  CXCR4 targeting guide RNA
cuuugcagccaacagcuuccu

SEQ ID NO: 2182 - RNA, 21 nt, Artificial Sequence
  CXCR4 targeting guide RNA
gaagcuguuggcugcaaaggu

SEQ ID NO: 2183 - RNA, 21 nt, Artificial Sequence
  CXCR4 targeting guide RNA
gaccaccuuugcagccaacag

SEQ ID NO: 2184 - RNA, 21 nt, Artificial Sequence
  CXCR4 targeting guide RNA
gacgccaacauagaccaccuu

SEQ ID NO: 2185 - RNA, 21 nt, Artificial Sequence
  CXCR4 targeting guide RNA
gaggccaaggaagcuguuggc

SEQ ID NO: 2186 - RNA, 21 nt, Artificial Sequence
  CXCR4 targeting guide RNA
gcaaagguggucuauguuggc

SEQ ID NO: 2187 - RNA, 21 nt, Artificial Sequence
  CXCR4 targeting guide RNA
gcagccaacagcuuccuuggc

SEQ ID NO: 2188 - RNA, 21 nt, Artificial Sequence
  CXCR4 targeting guide RNA
gccaacauagaccaccuuugc

SEQ ID NO: 2189 - RNA, 21 nt, Artificial Sequence
  CXCR4 targeting guide RNA
gccaaggaagcuguuggcugc

SEQ ID NO: 2190 - RNA, 21 nt, Artificial Sequence
  CXCR4 targeting guide RNA
gcugcaaagguggucuauguu

SEQ ID NO: 2191 - RNA, 21 nt, Artificial Sequence
  CXCR4 targeting guide RNA
gcuguuggcugcaaagguggu

SEQ ID NO: 2192 - RNA, 21 nt, Artificial Sequence
  CXCR4 targeting guide RNA
ggaagcuguuggcugcaaagg

SEQ ID NO: 2193 - RNA, 21 nt, Artificial Sequence
  CXCR4 targeting guide RNA
ggccaaggaagcuguuggcug

SEQ ID NO: 2194 - RNA, 21 nt, Artificial Sequence
  CXCR4 targeting guide RNA
ggcugcaaagguggucuaugu

SEQ ID NO: 2195 - RNA, 21 nt, Artificial Sequence
  CXCR4 targeting guide RNA
guuggcugcaaagguggucua

SEQ ID NO: 2196 - RNA, 21 nt, Artificial Sequence
  CXCR4 targeting guide RNA
uagaccaccuuugcagccaac

SEQ ID NO: 2197 - RNA, 21 nt, Artificial Sequence
  CXCR4 targeting guide RNA
ugcaaagguggucuauguugg

SEQ ID NO: 2198 - RNA, 21 nt, Artificial Sequence
  CXCR4 targeting guide RNA
ugcagccaacagcuuccuugg

SEQ ID NO: 2199 - RNA, 21 nt, Artificial Sequence
  CXCR4 targeting guide RNA
uggcugcaaagguggucuaug

SEQ ID NO: 2200 - RNA, 21 nt, Artificial Sequence
  CXCR4 targeting guide RNA
uguuggcugcaaagguggucu

SEQ ID NO: 2201 - RNA, 21 nt, Artificial Sequence
  CXCR4 targeting guide RNA
uugcagccaacagcuuccuug

SEQ ID NO: 2202 - RNA, 21 nt, Artificial Sequence
  CXCR4 targeting guide RNA
uuggcugcaaagguggucuau

SEQ ID NO: 2203 - RNA, 21 nt, Artificial Sequence
  CXCR4 targeting guide RNA
uuugcagccaacagcuuccuu

SEQ ID NO: 2204 - RNA, 22 nt, Artificial Sequence
  CXCR4 targeting guide RNA
aacauagaccaccuuugcagcc

SEQ ID NO: 2205 - RNA, 22 nt, Artificial Sequence
  CXCR4 targeting guide RNA
aagcuguuggcugcaaaggugg

SEQ ID NO: 2206 - RNA, 22 nt, Artificial Sequence
  CXCR4 targeting guide RNA
aaggaagcuguuggcugcaaag

SEQ ID NO: 2207 - RNA, 22 nt, Artificial Sequence
  CXCR4 targeting guide RNA
acauagaccaccuuugcagcca

SEQ ID NO: 2208 - RNA, 22 nt, Artificial Sequence
  CXCR4 targeting guide RNA
accaccuuugcagccaacagcu

SEQ ID NO: 2209 - RNA, 22 nt, Artificial Sequence
  CXCR4 targeting guide RNA
accuuugcagccaacagcuucc

SEQ ID NO: 2210 - RNA, 22 nt, Artificial Sequence
  CXCR4 targeting guide RNA
acgccaacauagaccaccuuug

SEQ ID NO: 2211 - RNA, 22 nt, Artificial Sequence
  CXCR4 targeting guide RNA
agaccaccuuugcagccaacag

SEQ ID NO: 2212 - RNA, 22 nt, Artificial Sequence
  CXCR4 targeting guide RNA
agacgccaacauagaccaccuu

SEQ ID NO: 2213 - RNA, 22 nt, Artificial Sequence
  CXCR4 targeting guide RNA
agaggccaaggaagcuguuggc

SEQ ID NO: 2214 - RNA, 22 nt, Artificial Sequence
  CXCR4 targeting guide RNA
agcuguuggcugcaaagguggu

SEQ ID NO: 2215 - RNA, 22 nt, Artificial Sequence
  CXCR4 targeting guide RNA
aggaagcuguuggcugcaaagg

SEQ ID NO: 2216 - RNA, 22 nt, Artificial Sequence
  CXCR4 targeting guide RNA
aggccaaggaagcuguuggcug

SEQ ID NO: 2217 - RNA, 22 nt, Artificial Sequence
  CXCR4 targeting guide RNA
auagaccaccuuugcagccaac

SEQ ID NO: 2218 - RNA, 22 nt, Artificial Sequence
  CXCR4 targeting guide RNA
caacauagaccaccuuugcagc

SEQ ID NO: 2219 - RNA, 22 nt, Artificial Sequence
  CXCR4 targeting guide RNA
caaggaagcuguuggcugcaaa

SEQ ID NO: 2220 - RNA, 22 nt, Artificial Sequence
  CXCR4 targeting guide RNA
caccuuugcagccaacagcuuc

SEQ ID NO: 2221 - RNA, 22 nt, Artificial Sequence
  CXCR4 targeting guide RNA
cagacgccaacauagaccaccu

SEQ ID NO: 2222 - RNA, 22 nt, Artificial Sequence
  CXCR4 targeting guide RNA
cagaggccaaggaagcuguugg

SEQ ID NO: 2223 - RNA, 22 nt, Artificial Sequence
  CXCR4 targeting guide RNA
cauagaccaccuuugcagccaa

SEQ ID NO: 2224 - RNA, 22 nt, Artificial Sequence
  CXCR4 targeting guide RNA
ccaacauagaccaccuuugcag

SEQ ID NO: 2225 - RNA, 22 nt, Artificial Sequence
  CXCR4 targeting guide RNA
ccaaggaagcuguuggcugcaa

SEQ ID NO: 2226 - RNA, 22 nt, Artificial Sequence
  CXCR4 targeting guide RNA
ccaccuuugcagccaacagcuu

SEQ ID NO: 2227 - RNA, 22 nt, Artificial Sequence
  CXCR4 targeting guide RNA
ccuuugcagccaacagcuuccu

SEQ ID NO: 2228 - RNA, 22 nt, Artificial Sequence
  CXCR4 targeting guide RNA
cgccaacauagaccaccuuugc

SEQ ID NO: 2229 - RNA, 22 nt, Artificial Sequence
  CXCR4 targeting guide RNA
cugcaaagguggucuauguugg

SEQ ID NO: 2230 - RNA, 22 nt, Artificial Sequence
  CXCR4 targeting guide RNA
cuguuggcugcaaagguggucu

SEQ ID NO: 2231 - RNA, 22 nt, Artificial Sequence
  CXCR4 targeting guide RNA
cuuugcagccaacagcuuccuu

SEQ ID NO: 2232 - RNA, 22 nt, Artificial Sequence
  CXCR4 targeting guide RNA
gaagcuguuggcugcaaaggug

SEQ ID NO: 2233 - RNA, 22 nt, Artificial Sequence
  CXCR4 targeting guide RNA
gaccaccuuugcagccaacagc

SEQ ID NO: 2234 - RNA, 22 nt, Artificial Sequence
  CXCR4 targeting guide RNA
gacgccaacauagaccaccuuu

SEQ ID NO: 2235 - RNA, 22 nt, Artificial Sequence
  CXCR4 targeting guide RNA
gaggccaaggaagcuguuggcu

SEQ ID NO: 2236 - RNA, 22 nt, Artificial Sequence
  CXCR4 targeting guide RNA
gcaaagguggucuauguuggcg

SEQ ID NO: 2237 - RNA, 22 nt, Artificial Sequence
  CXCR4 targeting guide RNA
gcagccaacagcuuccuuggcc

SEQ ID NO: 2238 - RNA, 22 nt, Artificial Sequence
  CXCR4 targeting guide RNA
gccaacauagaccaccuuugca

SEQ ID NO: 2239 - RNA, 22 nt, Artificial Sequence
  CXCR4 targeting guide RNA
gccaaggaagcuguuggcugca

SEQ ID NO: 2240 - RNA, 22 nt, Artificial Sequence
  CXCR4 targeting guide RNA
gcugcaaagguggucuauguug

SEQ ID NO: 2241 - RNA, 22 nt, Artificial Sequence
  CXCR4 targeting guide RNA
gcuguuggcugcaaaggugguc

SEQ ID NO: 2242 - RNA, 22 nt, Artificial Sequence
  CXCR4 targeting guide RNA
ggaagcuguuggcugcaaaggu

SEQ ID NO: 2243 - RNA, 22 nt, Artificial Sequence
  CXCR4 targeting guide RNA
ggccaaggaagcuguuggcugc

SEQ ID NO: 2244 - RNA, 22 nt, Artificial Sequence
  CXCR4 targeting guide RNA
ggcugcaaagguggucuauguu

SEQ ID NO: 2245 - RNA, 22 nt, Artificial Sequence
  CXCR4 targeting guide RNA
guuggcugcaaagguggucuau

SEQ ID NO: 2246 - RNA, 22 nt, Artificial Sequence
  CXCR4 targeting guide RNA
uagaccaccuuugcagccaaca

SEQ ID NO: 2247 - RNA, 22 nt, Artificial Sequence
  CXCR4 targeting guide RNA
ugcaaagguggucuauguuggc

SEQ ID NO: 2248 - RNA, 22 nt, Artificial Sequence
  CXCR4 targeting guide RNA
ugcagccaacagcuuccuuggc

SEQ ID NO: 2249 - RNA, 22 nt, Artificial Sequence
  CXCR4 targeting guide RNA
uggcugcaaagguggucuaugu

SEQ ID NO: 2250 - RNA, 22 nt, Artificial Sequence
  CXCR4 targeting guide RNA
uguuggcugcaaagguggucua

SEQ ID NO: 2251 - RNA, 22 nt, Artificial Sequence
  CXCR4 targeting guide RNA
uugcagccaacagcuuccuugg

SEQ ID NO: 2252 - RNA, 22 nt, Artificial Sequence
  CXCR4 targeting guide RNA
uuggcugcaaagguggucuaug

SEQ ID NO: 2253 - RNA, 22 nt, Artificial Sequence
  CXCR4 targeting guide RNA
uuugcagccaacagcuuccuug

SEQ ID NO: 2254 - RNA, 20 nt, Artificial Sequence
  CXCR4 targeting guide RNA
aaagaggaggugggccacug

SEQ ID NO: 2255 - RNA, 20 nt, Artificial Sequence
  CXCR4 targeting guide RNA
aagaggaggugggccacuga

SEQ ID NO: 2256 - RNA, 20 nt, Artificial Sequence
  CXCR4 targeting guide RNA
acaaagaggaggugggccac

SEQ ID NO: 2257 - RNA, 20 nt, Artificial Sequence
  CXCR4 targeting guide RNA
acaggcugcaccugucagug

SEQ ID NO: 2258 - RNA, 20 nt, Artificial Sequence
  CXCR4 targeting guide RNA
accugucaguggcccaccuc

SEQ ID NO: 2259 - RNA, 20 nt, Artificial Sequence
  CXCR4 targeting guide RNA
agaggaggugggccacugac

SEQ ID NO: 2260 - RNA, 20 nt, Artificial Sequence
  CXCR4 targeting guide RNA
agcgugaugacaaagaggag

SEQ ID NO: 2261 - RNA, 20 nt, Artificial Sequence
  CXCR4 targeting guide RNA
aggaggugggccacugacag

SEQ ID NO: 2262 - RNA, 20 nt, Artificial Sequence
  CXCR4 targeting guide RNA
aggcugcaccugucaguggc

SEQ ID NO: 2263 - RNA, 20 nt, Artificial Sequence
  CXCR4 targeting guide RNA
aggugggccacugacaggug

SEQ ID NO: 2264 - RNA, 20 nt, Artificial Sequence
  CXCR4 targeting guide RNA
aguggcccaccuccucuuug

SEQ ID NO: 2265 - RNA, 20 nt, Artificial Sequence
  CXCR4 targeting guide RNA
augacaaagaggaggugggc

SEQ ID NO: 2266 - RNA, 20 nt, Artificial Sequence
  CXCR4 targeting guide RNA
caaagaggaggugggccacu

SEQ ID NO: 2267 - RNA, 20 nt, Artificial Sequence
  CXCR4 targeting guide RNA
caccugucaguggcccaccu

SEQ ID NO: 2268 - RNA, 20 nt, Artificial Sequence
  CXCR4 targeting guide RNA
caggcugcaccugucagugg

SEQ ID NO: 2269 - RNA, 20 nt, Artificial Sequence
  CXCR4 targeting guide RNA
caguggcccaccuccucuuu

SEQ ID NO: 2270 - RNA, 20 nt, Artificial Sequence
  CXCR4 targeting guide RNA
ccaccuccucuuugucauca

SEQ ID NO: 2271 - RNA, 20 nt, Artificial Sequence
  CXCR4 targeting guide RNA
cccaccuccucuuugucauc

SEQ ID NO: 2272 - RNA, 20 nt, Artificial Sequence
  CXCR4 targeting guide RNA
ccugucaguggcccaccucc

SEQ ID NO: 2273 - RNA, 20 nt, Artificial Sequence
  CXCR4 targeting guide RNA
cgugaugacaaagaggaggu

SEQ ID NO: 2274 - RNA, 20 nt, Artificial Sequence
  CXCR4 targeting guide RNA
cugcaccugucaguggccca

SEQ ID NO: 2275 - RNA, 20 nt, Artificial Sequence
  CXCR4 targeting guide RNA
cugucaguggcccaccuccu

SEQ ID NO: 2276 - RNA, 20 nt, Artificial Sequence
  CXCR4 targeting guide RNA
gacaaagaggaggugggcca

SEQ ID NO: 2277 - RNA, 20 nt, Artificial Sequence
  CXCR4 targeting guide RNA
gaggaggugggccacugaca

SEQ ID NO: 2278 - RNA, 20 nt, Artificial Sequence
  CXCR4 targeting guide RNA
gaggugggccacugacaggu

SEQ ID NO: 2279 - RNA, 20 nt, Artificial Sequence
  CXCR4 targeting guide RNA
gaugacaaagaggagguggg

SEQ ID NO: 2280 - RNA, 20 nt, Artificial Sequence
  CXCR4 targeting guide RNA
gcaccugucaguggcccacc

SEQ ID NO: 2281 - RNA, 20 nt, Artificial Sequence
  CXCR4 targeting guide RNA
gcccaccuccucuuugucau

SEQ ID NO: 2282 - RNA, 20 nt, Artificial Sequence
  CXCR4 targeting guide RNA
gcgugaugacaaagaggagg

SEQ ID NO: 2283 - RNA, 20 nt, Artificial Sequence
  CXCR4 targeting guide RNA
gcugcaccugucaguggccc

SEQ ID NO: 2284 - RNA, 20 nt, Artificial Sequence
  CXCR4 targeting guide RNA
ggaggugggccacugacagg

SEQ ID NO: 2285 - RNA, 20 nt, Artificial Sequence
  CXCR4 targeting guide RNA
ggcccaccuccucuuuguca

SEQ ID NO: 2286 - RNA, 20 nt, Artificial Sequence
  CXCR4 targeting guide RNA
ggcugcaccugucaguggcc

SEQ ID NO: 2287 - RNA, 20 nt, Artificial Sequence
  CXCR4 targeting guide RNA
gggccacugacaggugcagc

SEQ ID NO: 2288 - RNA, 20 nt, Artificial Sequence
  CXCR4 targeting guide RNA
ggugggccacugacaggugc

SEQ ID NO: 2289 - RNA, 20 nt, Artificial Sequence
  CXCR4 targeting guide RNA
gucaguggcccaccuccucu

SEQ ID NO: 2290 - RNA, 20 nt, Artificial Sequence
  CXCR4 targeting guide RNA
gugaugacaaagaggaggug

SEQ ID NO: 2291 - RNA, 20 nt, Artificial Sequence
  CXCR4 targeting guide RNA
guggcccaccuccucuuugu

SEQ ID NO: 2292 - RNA, 20 nt, Artificial Sequence
  CXCR4 targeting guide RNA
gugggccacugacaggugca

SEQ ID NO: 2293 - RNA, 20 nt, Artificial Sequence
  CXCR4 targeting guide RNA
ucaguggcccaccuccucuu

SEQ ID NO: 2294 - RNA, 20 nt, Artificial Sequence
  CXCR4 targeting guide RNA
ugacaaagaggaggugggcc

SEQ ID NO: 2295 - RNA, 20 nt, Artificial Sequence
  CXCR4 targeting guide RNA
ugaugacaaagaggaggugg

SEQ ID NO: 2296 - RNA, 20 nt, Artificial Sequence
  CXCR4 targeting guide RNA
ugcaccugucaguggcccac

SEQ ID NO: 2297 - RNA, 20 nt, Artificial Sequence
  CXCR4 targeting guide RNA
uggcccaccuccucuuuguc

SEQ ID NO: 2298 - RNA, 20 nt, Artificial Sequence
  CXCR4 targeting guide RNA
ugggccacugacaggugcag

SEQ ID NO: 2299 - RNA, 20 nt, Artificial Sequence
  CXCR4 targeting guide RNA
ugucaguggcccaccuccuc

SEQ ID NO: 2300 - RNA, 21 nt, Artificial Sequence
  CXCR4 targeting guide RNA
aaagaggaggugggccacuga

SEQ ID NO: 2301 - RNA, 21 nt, Artificial Sequence
  CXCR4 targeting guide RNA
aagaggaggugggccacugac

SEQ ID NO: 2302 - RNA, 21 nt, Artificial Sequence
  CXCR4 targeting guide RNA
aagcgugaugacaaagaggag

SEQ ID NO: 2303 - RNA, 21 nt, Artificial Sequence
  CXCR4 targeting guide RNA
acaaagaggaggugggccacu

SEQ ID NO: 2304 - RNA, 21 nt, Artificial Sequence
  CXCR4 targeting guide RNA
acaggcugcaccugucagugg

SEQ ID NO: 2305 - RNA, 21 nt, Artificial Sequence
  CXCR4 targeting guide RNA
accugucaguggcccaccucc

SEQ ID NO: 2306 - RNA, 21 nt, Artificial Sequence
  CXCR4 targeting guide RNA
agaggaggugggccacugaca

SEQ ID NO: 2307 - RNA, 21 nt, Artificial Sequence
  CXCR4 targeting guide RNA
agcgugaugacaaagaggagg

SEQ ID NO: 2308 - RNA, 21 nt, Artificial Sequence
  CXCR4 targeting guide RNA
aggaggugggccacugacagg

SEQ ID NO: 2309 - RNA, 21 nt, Artificial Sequence
  CXCR4 targeting guide RNA
aggcugcaccugucaguggcc

SEQ ID NO: 2310 - RNA, 21 nt, Artificial Sequence
  CXCR4 targeting guide RNA
aggugggccacugacaggugc

SEQ ID NO: 2311 - RNA, 21 nt, Artificial Sequence
  CXCR4 targeting guide RNA
aguggcccaccuccucuuugu

SEQ ID NO: 2312 - RNA, 21 nt, Artificial Sequence
  CXCR4 targeting guide RNA
augacaaagaggaggugggcc

SEQ ID NO: 2313 - RNA, 21 nt, Artificial Sequence
  CXCR4 targeting guide RNA
caaagaggaggugggccacug

SEQ ID NO: 2314 - RNA, 21 nt, Artificial Sequence
  CXCR4 targeting guide RNA
caccugucaguggcccaccuc

SEQ ID NO: 2315 - RNA, 21 nt, Artificial Sequence
  CXCR4 targeting guide RNA
caggcugcaccugucaguggc

SEQ ID NO: 2316 - RNA, 21 nt, Artificial Sequence
  CXCR4 targeting guide RNA
caguggcccaccuccucuuug

SEQ ID NO: 2317 - RNA, 21 nt, Artificial Sequence
  CXCR4 targeting guide RNA
ccaccuccucuuugucaucac

SEQ ID NO: 2318 - RNA, 21 nt, Artificial Sequence
  CXCR4 targeting guide RNA
cccaccuccucuuugucauca

SEQ ID NO: 2319 - RNA, 21 nt, Artificial Sequence
  CXCR4 targeting guide RNA
ccugucaguggcccaccuccu

SEQ ID NO: 2320 - RNA, 21 nt, Artificial Sequence
  CXCR4 targeting guide RNA
cgugaugacaaagaggaggug

SEQ ID NO: 2321 - RNA, 21 nt, Artificial Sequence
  CXCR4 targeting guide RNA
cugcaccugucaguggcccac

SEQ ID NO: 2322 - RNA, 21 nt, Artificial Sequence
  CXCR4 targeting guide RNA
cugucaguggcccaccuccuc

SEQ ID NO: 2323 - RNA, 21 nt, Artificial Sequence
  CXCR4 targeting guide RNA
gacaaagaggaggugggccac

SEQ ID NO: 2324 - RNA, 21 nt, Artificial Sequence
  CXCR4 targeting guide RNA
gaggaggugggccacugacag

SEQ ID NO: 2325 - RNA, 21 nt, Artificial Sequence
  CXCR4 targeting guide RNA
gaggugggccacugacaggug

SEQ ID NO: 2326 - RNA, 21 nt, Artificial Sequence
  CXCR4 targeting guide RNA
gaugacaaagaggaggugggc

SEQ ID NO: 2327 - RNA, 21 nt, Artificial Sequence
  CXCR4 targeting guide RNA
gcaccugucaguggcccaccu

SEQ ID NO: 2328 - RNA, 21 nt, Artificial Sequence
  CXCR4 targeting guide RNA
gcccaccuccucuuugucauc

SEQ ID NO: 2329 - RNA, 21 nt, Artificial Sequence
  CXCR4 targeting guide RNA
gcgugaugacaaagaggaggu

SEQ ID NO: 2330 - RNA, 21 nt, Artificial Sequence
  CXCR4 targeting guide RNA
gcugcaccugucaguggccca

SEQ ID NO: 2331 - RNA, 21 nt, Artificial Sequence
  CXCR4 targeting guide RNA
ggaggugggccacugacaggu

SEQ ID NO: 2332 - RNA, 21 nt, Artificial Sequence
  CXCR4 targeting guide RNA
ggcccaccuccucuuugucau

SEQ ID NO: 2333 - RNA, 21 nt, Artificial Sequence
  CXCR4 targeting guide RNA
ggcugcaccugucaguggccc

SEQ ID NO: 2334 - RNA, 21 nt, Artificial Sequence
  CXCR4 targeting guide RNA
gggccacugacaggugcagcc

SEQ ID NO: 2335 - RNA, 21 nt, Artificial Sequence
  CXCR4 targeting guide RNA
ggugggccacugacaggugca

SEQ ID NO: 2336 - RNA, 21 nt, Artificial Sequence
  CXCR4 targeting guide RNA
gucaguggcccaccuccucuu

SEQ ID NO: 2337 - RNA, 21 nt, Artificial Sequence
  CXCR4 targeting guide RNA
gugaugacaaagaggaggugg

SEQ ID NO: 2338 - RNA, 21 nt, Artificial Sequence
  CXCR4 targeting guide RNA
guggcccaccuccucuuuguc

SEQ ID NO: 2339 - RNA, 21 nt, Artificial Sequence
  CXCR4 targeting guide RNA
gugggccacugacaggugcag

SEQ ID NO: 2340 - RNA, 21 nt, Artificial Sequence
  CXCR4 targeting guide RNA
uacaggcugcaccugucagug

SEQ ID NO: 2341 - RNA, 21 nt, Artificial Sequence
  CXCR4 targeting guide RNA
ucaguggcccaccuccucuuu

SEQ ID NO: 2342 - RNA, 21 nt, Artificial Sequence
  CXCR4 targeting guide RNA
ugacaaagaggaggugggcca

SEQ ID NO: 2343 - RNA, 21 nt, Artificial Sequence
  CXCR4 targeting guide RNA
ugaugacaaagaggagguggg

SEQ ID NO: 2344 - RNA, 21 nt, Artificial Sequence
  CXCR4 targeting guide RNA
ugcaccugucaguggcccacc

SEQ ID NO: 2345 - RNA, 21 nt, Artificial Sequence
  CXCR4 targeting guide RNA
uggcccaccuccucuuuguca

SEQ ID NO: 2346 - RNA, 21 nt, Artificial Sequence
  CXCR4 targeting guide RNA
ugggccacugacaggugcagc

SEQ ID NO: 2347 - RNA, 21 nt, Artificial Sequence
  CXCR4 targeting guide RNA
ugucaguggcccaccuccucu

SEQ ID NO: 2348 - RNA, 22 nt, Artificial Sequence
  CXCR4 targeting guide RNA
aaagaggaggugggccacugac

SEQ ID NO: 2349 - RNA, 22 nt, Artificial Sequence
  CXCR4 targeting guide RNA
aagaggaggugggccacugaca

SEQ ID NO: 2350 - RNA, 22 nt, Artificial Sequence
  CXCR4 targeting guide RNA
aagcgugaugacaaagaggagg

SEQ ID NO: 2351 - RNA, 22 nt, Artificial Sequence
  CXCR4 targeting guide RNA
acaaagaggaggugggccacug

SEQ ID NO: 2352 - RNA, 22 nt, Artificial Sequence
  CXCR4 targeting guide RNA
acaggcugcaccugucaguggc

SEQ ID NO: 2353 - RNA, 22 nt, Artificial Sequence
  CXCR4 targeting guide RNA
accugucaguggcccaccuccu

SEQ ID NO: 2354 - RNA, 22 nt, Artificial Sequence
  CXCR4 targeting guide RNA
agaggaggugggccacugacag

SEQ ID NO: 2355 - RNA, 22 nt, Artificial Sequence
  CXCR4 targeting guide RNA
agcgugaugacaaagaggaggu

SEQ ID NO: 2356 - RNA, 22 nt, Artificial Sequence
  CXCR4 targeting guide RNA
aggaggugggccacugacaggu

SEQ ID NO: 2357 - RNA, 22 nt, Artificial Sequence
  CXCR4 targeting guide RNA
aggcugcaccugucaguggccc

SEQ ID NO: 2358 - RNA, 22 nt, Artificial Sequence
  CXCR4 targeting guide RNA
aggugggccacugacaggugca

SEQ ID NO: 2359 - RNA, 22 nt, Artificial Sequence
  CXCR4 targeting guide RNA
aguggcccaccuccucuuuguc

SEQ ID NO: 2360 - RNA, 22 nt, Artificial Sequence
  CXCR4 targeting guide RNA
augacaaagaggaggugggcca

SEQ ID NO: 2361 - RNA, 22 nt, Artificial Sequence
  CXCR4 targeting guide RNA
caaagaggaggugggccacuga

SEQ ID NO: 2362 - RNA, 22 nt, Artificial Sequence
  CXCR4 targeting guide RNA
caccugucaguggcccaccucc

SEQ ID NO: 2363 - RNA, 22 nt, Artificial Sequence
  CXCR4 targeting guide RNA
caggcugcaccugucaguggcc

SEQ ID NO: 2364 - RNA, 22 nt, Artificial Sequence
  CXCR4 targeting guide RNA
caguggcccaccuccucuuugu

SEQ ID NO: 2365 - RNA, 22 nt, Artificial Sequence
  CXCR4 targeting guide RNA
ccaccuccucuuugucaucacg

SEQ ID NO: 2366 - RNA, 22 nt, Artificial Sequence
  CXCR4 targeting guide RNA
cccaccuccucuuugucaucac

SEQ ID NO: 2367 - RNA, 22 nt, Artificial Sequence
  CXCR4 targeting guide RNA
ccugucaguggcccaccuccuc

SEQ ID NO: 2368 - RNA, 22 nt, Artificial Sequence
  CXCR4 targeting guide RNA
cgugaugacaaagaggaggugg

SEQ ID NO: 2369 - RNA, 22 nt, Artificial Sequence
  CXCR4 targeting guide RNA
cugcaccugucaguggcccacc

SEQ ID NO: 2370 - RNA, 22 nt, Artificial Sequence
  CXCR4 targeting guide RNA
cugucaguggcccaccuccucu

SEQ ID NO: 2371 - RNA, 22 nt, Artificial Sequence
  CXCR4 targeting guide RNA
gaagcgugaugacaaagaggag

SEQ ID NO: 2372 - RNA, 22 nt, Artificial Sequence
  CXCR4 targeting guide RNA
gacaaagaggaggugggccacu

SEQ ID NO: 2373 - RNA, 22 nt, Artificial Sequence
  CXCR4 targeting guide RNA
gaggaggugggccacugacagg

SEQ ID NO: 2374 - RNA, 22 nt, Artificial Sequence
  CXCR4 targeting guide RNA
gaggugggccacugacaggugc

SEQ ID NO: 2375 - RNA, 22 nt, Artificial Sequence
  CXCR4 targeting guide RNA
gaugacaaagaggaggugggcc

SEQ ID NO: 2376 - RNA, 22 nt, Artificial Sequence
  CXCR4 targeting guide RNA
gcaccugucaguggcccaccuc

SEQ ID NO: 2377 - RNA, 22 nt, Artificial Sequence
  CXCR4 targeting guide RNA
gcccaccuccucuuugucauca

SEQ ID NO: 2378 - RNA, 22 nt, Artificial Sequence
  CXCR4 targeting guide RNA
gcgugaugacaaagaggaggug

SEQ ID NO: 2379 - RNA, 22 nt, Artificial Sequence
  CXCR4 targeting guide RNA
gcugcaccugucaguggcccac

SEQ ID NO: 2380 - RNA, 22 nt, Artificial Sequence
  CXCR4 targeting guide RNA
ggaggugggccacugacaggug

SEQ ID NO: 2381 - RNA, 22 nt, Artificial Sequence
  CXCR4 targeting guide RNA
ggcccaccuccucuuugucauc

SEQ ID NO: 2382 - RNA, 22 nt, Artificial Sequence
  CXCR4 targeting guide RNA
ggcugcaccugucaguggccca

SEQ ID NO: 2383 - RNA, 22 nt, Artificial Sequence
  CXCR4 targeting guide RNA
gggccacugacaggugcagccu

SEQ ID NO: 2384 - RNA, 22 nt, Artificial Sequence
  CXCR4 targeting guide RNA
ggugggccacugacaggugcag

SEQ ID NO: 2385 - RNA, 22 nt, Artificial Sequence
  CXCR4 targeting guide RNA
guacaggcugcaccugucagug

SEQ ID NO: 2386 - RNA, 22 nt, Artificial Sequence
  CXCR4 targeting guide RNA
gucaguggcccaccuccucuuu

SEQ ID NO: 2387 - RNA, 22 nt, Artificial Sequence
  CXCR4 targeting guide RNA
gugaugacaaagaggagguggg

SEQ ID NO: 2388 - RNA, 22 nt, Artificial Sequence
  CXCR4 targeting guide RNA
guggcccaccuccucuuuguca

SEQ ID NO: 2389 - RNA, 22 nt, Artificial Sequence
  CXCR4 targeting guide RNA
gugggccacugacaggugcagc

SEQ ID NO: 2390 - RNA, 22 nt, Artificial Sequence
  CXCR4 targeting guide RNA
uacaggcugcaccugucagugg

SEQ ID NO: 2391 - RNA, 22 nt, Artificial Sequence
  CXCR4 targeting guide RNA
ucaguggcccaccuccucuuug

SEQ ID NO: 2392 - RNA, 22 nt, Artificial Sequence
  CXCR4 targeting guide RNA
ugacaaagaggaggugggccac

SEQ ID NO: 2393 - RNA, 22 nt, Artificial Sequence
  CXCR4 targeting guide RNA
ugaugacaaagaggaggugggc

SEQ ID NO: 2394 - RNA, 22 nt, Artificial Sequence
  CXCR4 targeting guide RNA
ugcaccugucaguggcccaccu

SEQ ID NO: 2395 - RNA, 22 nt, Artificial Sequence
  CXCR4 targeting guide RNA
uggcccaccuccucuuugucau

SEQ ID NO: 2396 - RNA, 22 nt, Artificial Sequence
  CXCR4 targeting guide RNA
ugggccacugacaggugcagcc

SEQ ID NO: 2397 - RNA, 22 nt, Artificial Sequence
  CXCR4 targeting guide RNA
ugucaguggcccaccuccucuu

SEQ ID NO: 2398 - RNA, 20 nt, Artificial Sequence
  CXCR4 targeting guide RNA
aaagaggagguuggccacug

SEQ ID NO: 2399 - RNA, 20 nt, Artificial Sequence
  CXCR4 targeting guide RNA
aagaggagguuggccacuga

SEQ ID NO: 2400 - RNA, 20 nt, Artificial Sequence
  CXCR4 targeting guide RNA
acaaagaggagguuggccac

SEQ ID NO: 2401 - RNA, 20 nt, Artificial Sequence
  CXCR4 targeting guide RNA
accugucaguggccaaccuc

SEQ ID NO: 2402 - RNA, 20 nt, Artificial Sequence
  CXCR4 targeting guide RNA
agaggagguuggccacugac

SEQ ID NO: 2403 - RNA, 20 nt, Artificial Sequence
  CXCR4 targeting guide RNA
aggagguuggccacugacag

SEQ ID NO: 2404 - RNA, 20 nt, Artificial Sequence
  CXCR4 targeting guide RNA
agguuggccacugacaggug

SEQ ID NO: 2405 - RNA, 20 nt, Artificial Sequence
  CXCR4 targeting guide RNA
aguggccaaccuccucuuug

SEQ ID NO: 2406 - RNA, 20 nt, Artificial Sequence
  CXCR4 targeting guide RNA
augacaaagaggagguuggc

SEQ ID NO: 2407 - RNA, 20 nt, Artificial Sequence
  CXCR4 targeting guide RNA
caaagaggagguuggccacu

SEQ ID NO: 2408 - RNA, 20 nt, Artificial Sequence
  CXCR4 targeting guide RNA
caaccuccucuuugucauca

SEQ ID NO: 2409 - RNA, 20 nt, Artificial Sequence
  CXCR4 targeting guide RNA
caccugucaguggccaaccu

SEQ ID NO: 2410 - RNA, 20 nt, Artificial Sequence
  CXCR4 targeting guide RNA
caguggccaaccuccucuuu

SEQ ID NO: 2411 - RNA, 20 nt, Artificial Sequence
  CXCR4 targeting guide RNA
ccaaccuccucuuugucauc

SEQ ID NO: 2412 - RNA, 20 nt, Artificial Sequence
  CXCR4 targeting guide RNA
ccugucaguggccaaccucc

SEQ ID NO: 2413 - RNA, 20 nt, Artificial Sequence
  CXCR4 targeting guide RNA
cugcaccugucaguggccaa

SEQ ID NO: 2414 - RNA, 20 nt, Artificial Sequence
  CXCR4 targeting guide RNA
cugucaguggccaaccuccu

SEQ ID NO: 2415 - RNA, 20 nt, Artificial Sequence
  CXCR4 targeting guide RNA
gacaaagaggagguuggcca

SEQ ID NO: 2416 - RNA, 20 nt, Artificial Sequence
  CXCR4 targeting guide RNA
gaggagguuggccacugaca

SEQ ID NO: 2417 - RNA, 20 nt, Artificial Sequence
  CXCR4 targeting guide RNA
gagguuggccacugacaggu

SEQ ID NO: 2418 - RNA, 20 nt, Artificial Sequence
  CXCR4 targeting guide RNA
gaugacaaagaggagguugg

SEQ ID NO: 2419 - RNA, 20 nt, Artificial Sequence
  CXCR4 targeting guide RNA
gcaccugucaguggccaacc

SEQ ID NO: 2420 - RNA, 20 nt, Artificial Sequence
  CXCR4 targeting guide RNA
gccaaccuccucuuugucau

SEQ ID NO: 2421 - RNA, 20 nt, Artificial Sequence
  CXCR4 targeting guide RNA
gcugcaccugucaguggcca

SEQ ID NO: 2422 - RNA, 20 nt, Artificial Sequence
  CXCR4 targeting guide RNA
ggagguuggccacugacagg

SEQ ID NO: 2423 - RNA, 20 nt, Artificial Sequence
  CXCR4 targeting guide RNA
ggccaaccuccucuuuguca

SEQ ID NO: 2424 - RNA, 20 nt, Artificial Sequence
  CXCR4 targeting guide RNA
gguuggccacugacaggugc

SEQ ID NO: 2425 - RNA, 20 nt, Artificial Sequence
  CXCR4 targeting guide RNA
gucaguggccaaccuccucu

SEQ ID NO: 2426 - RNA, 20 nt, Artificial Sequence
  CXCR4 targeting guide RNA
gugaugacaaagaggagguu

SEQ ID NO: 2427 - RNA, 20 nt, Artificial Sequence
  CXCR4 targeting guide RNA
guggccaaccuccucuuugu

SEQ ID NO: 2428 - RNA, 20 nt, Artificial Sequence
  CXCR4 targeting guide RNA
guuggccacugacaggugca

SEQ ID NO: 2429 - RNA, 20 nt, Artificial Sequence
  CXCR4 targeting guide RNA
ucaguggccaaccuccucuu

SEQ ID NO: 2430 - RNA, 20 nt, Artificial Sequence
  CXCR4 targeting guide RNA
ugacaaagaggagguuggcc

SEQ ID NO: 2431 - RNA, 20 nt, Artificial Sequence
  CXCR4 targeting guide RNA
ugaugacaaagaggagguug

SEQ ID NO: 2432 - RNA, 20 nt, Artificial Sequence
  CXCR4 targeting guide RNA
ugcaccugucaguggccaac

SEQ ID NO: 2433 - RNA, 20 nt, Artificial Sequence
  CXCR4 targeting guide RNA
uggccaaccuccucuuuguc

SEQ ID NO: 2434 - RNA, 20 nt, Artificial Sequence
  CXCR4 targeting guide RNA
uggccacugacaggugcagc

SEQ ID NO: 2435 - RNA, 20 nt, Artificial Sequence
  CXCR4 targeting guide RNA
ugucaguggccaaccuccuc

SEQ ID NO: 2436 - RNA, 20 nt, Artificial Sequence
  CXCR4 targeting guide RNA
uuggccacugacaggugcag

SEQ ID NO: 2437 - RNA, 21 nt, Artificial Sequence
  CXCR4 targeting guide RNA
aaagaggagguuggccacuga

SEQ ID NO: 2438 - RNA, 21 nt, Artificial Sequence
  CXCR4 targeting guide RNA
aagaggagguuggccacugac

SEQ ID NO: 2439 - RNA, 21 nt, Artificial Sequence
  CXCR4 targeting guide RNA
acaaagaggagguuggccacu

SEQ ID NO: 2440 - RNA, 21 nt, Artificial Sequence
  CXCR4 targeting guide RNA
accugucaguggccaaccucc

SEQ ID NO: 2441 - RNA, 21 nt, Artificial Sequence
  CXCR4 targeting guide RNA
agaggagguuggccacugaca

SEQ ID NO: 2442 - RNA, 21 nt, Artificial Sequence
  CXCR4 targeting guide RNA
aggagguuggccacugacagg

SEQ ID NO: 2443 - RNA, 21 nt, Artificial Sequence
  CXCR4 targeting guide RNA
agguuggccacugacaggugc

SEQ ID NO: 2444 - RNA, 21 nt, Artificial Sequence
  CXCR4 targeting guide RNA
aguggccaaccuccucuuugu

SEQ ID NO: 2445 - RNA, 21 nt, Artificial Sequence
  CXCR4 targeting guide RNA
augacaaagaggagguuggcc

SEQ ID NO: 2446 - RNA, 21 nt, Artificial Sequence
  CXCR4 targeting guide RNA
caaagaggagguuggccacug

SEQ ID NO: 2447 - RNA, 21 nt, Artificial Sequence
  CXCR4 targeting guide RNA
caaccuccucuuugucaucac

SEQ ID NO: 2448 - RNA, 21 nt, Artificial Sequence
  CXCR4 targeting guide RNA
caccugucaguggccaaccuc

SEQ ID NO: 2449 - RNA, 21 nt, Artificial Sequence
  CXCR4 targeting guide RNA
caguggccaaccuccucuuug

SEQ ID NO: 2450 - RNA, 21 nt, Artificial Sequence
  CXCR4 targeting guide RNA
ccaaccuccucuuugucauca

SEQ ID NO: 2451 - RNA, 21 nt, Artificial Sequence
  CXCR4 targeting guide RNA
ccugucaguggccaaccuccu

SEQ ID NO: 2452 - RNA, 21 nt, Artificial Sequence
  CXCR4 targeting guide RNA
cgugaugacaaagaggagguu

SEQ ID NO: 2453 - RNA, 21 nt, Artificial Sequence
  CXCR4 targeting guide RNA
cugcaccugucaguggccaac

SEQ ID NO: 2454 - RNA, 21 nt, Artificial Sequence
  CXCR4 targeting guide RNA
cugucaguggccaaccuccuc

SEQ ID NO: 2455 - RNA, 21 nt, Artificial Sequence
  CXCR4 targeting guide RNA
gacaaagaggagguuggccac

SEQ ID NO: 2456 - RNA, 21 nt, Artificial Sequence
  CXCR4 targeting guide RNA
gaggagguuggccacugacag

SEQ ID NO: 2457 - RNA, 21 nt, Artificial Sequence
  CXCR4 targeting guide RNA
gagguuggccacugacaggug

SEQ ID NO: 2458 - RNA, 21 nt, Artificial Sequence
  CXCR4 targeting guide RNA
gaugacaaagaggagguuggc

SEQ ID NO: 2459 - RNA, 21 nt, Artificial Sequence
  CXCR4 targeting guide RNA
gcaccugucaguggccaaccu

SEQ ID NO: 2460 - RNA, 21 nt, Artificial Sequence
  CXCR4 targeting guide RNA
gccaaccuccucuuugucauc

SEQ ID NO: 2461 - RNA, 21 nt, Artificial Sequence
  CXCR4 targeting guide RNA
gcugcaccugucaguggccaa

SEQ ID NO: 2462 - RNA, 21 nt, Artificial Sequence
  CXCR4 targeting guide RNA
ggagguuggccacugacaggu

SEQ ID NO: 2463 - RNA, 21 nt, Artificial Sequence
  CXCR4 targeting guide RNA
ggccaaccuccucuuugucau

SEQ ID NO: 2464 - RNA, 21 nt, Artificial Sequence
  CXCR4 targeting guide RNA
ggcugcaccugucaguggcca

SEQ ID NO: 2465 - RNA, 21 nt, Artificial Sequence
  CXCR4 targeting guide RNA
gguuggccacugacaggugca

SEQ ID NO: 2466 - RNA, 21 nt, Artificial Sequence
  CXCR4 targeting guide RNA
gucaguggccaaccuccucuu

SEQ ID NO: 2467 - RNA, 21 nt, Artificial Sequence
  CXCR4 targeting guide RNA
gugaugacaaagaggagguug

SEQ ID NO: 2468 - RNA, 21 nt, Artificial Sequence
  CXCR4 targeting guide RNA
guggccaaccuccucuuuguc

SEQ ID NO: 2469 - RNA, 21 nt, Artificial Sequence
  CXCR4 targeting guide RNA
guuggccacugacaggugcag

SEQ ID NO: 2470 - RNA, 21 nt, Artificial Sequence
  CXCR4 targeting guide RNA
ucaguggccaaccuccucuuu

SEQ ID NO: 2471 - RNA, 21 nt, Artificial Sequence
  CXCR4 targeting guide RNA
ugacaaagaggagguuggcca

SEQ ID NO: 2472 - RNA, 21 nt, Artificial Sequence
  CXCR4 targeting guide RNA
ugaugacaaagaggagguugg

SEQ ID NO: 2473 - RNA, 21 nt, Artificial Sequence
  CXCR4 targeting guide RNA
ugcaccugucaguggccaacc

SEQ ID NO: 2474 - RNA, 21 nt, Artificial Sequence
  CXCR4 targeting guide RNA
uggccaaccuccucuuuguca

SEQ ID NO: 2475 - RNA, 21 nt, Artificial Sequence
  CXCR4 targeting guide RNA
uggccacugacaggugcagcc

SEQ ID NO: 2476 - RNA, 21 nt, Artificial Sequence
  CXCR4 targeting guide RNA
ugucaguggccaaccuccucu

SEQ ID NO: 2477 - RNA, 21 nt, Artificial Sequence
  CXCR4 targeting guide RNA
uuggccacugacaggugcagc

SEQ ID NO: 2478 - RNA, 22 nt, Artificial Sequence
  CXCR4 targeting guide RNA
aaagaggagguuggccacugac

SEQ ID NO: 2479 - RNA, 22 nt, Artificial Sequence
  CXCR4 targeting guide RNA
aagaggagguuggccacugaca

SEQ ID NO: 2480 - RNA, 22 nt, Artificial Sequence
  CXCR4 targeting guide RNA
acaaagaggagguuggccacug

SEQ ID NO: 2481 - RNA, 22 nt, Artificial Sequence
  CXCR4 targeting guide RNA
accugucaguggccaaccuccu

SEQ ID NO: 2482 - RNA, 22 nt, Artificial Sequence
  CXCR4 targeting guide RNA
agaggagguuggccacugacag

SEQ ID NO: 2483 - RNA, 22 nt, Artificial Sequence
  CXCR4 targeting guide RNA
aggagguuggccacugacaggu

SEQ ID NO: 2484 - RNA, 22 nt, Artificial Sequence
  CXCR4 targeting guide RNA
aggcugcaccugucaguggcca

SEQ ID NO: 2485 - RNA, 22 nt, Artificial Sequence
  CXCR4 targeting guide RNA
agguuggccacugacaggugca

SEQ ID NO: 2486 - RNA, 22 nt, Artificial Sequence
  CXCR4 targeting guide RNA
aguggccaaccuccucuuuguc

SEQ ID NO: 2487 - RNA, 22 nt, Artificial Sequence
  CXCR4 targeting guide RNA
augacaaagaggagguuggcca

SEQ ID NO: 2488 - RNA, 22 nt, Artificial Sequence
  CXCR4 targeting guide RNA
caaagaggagguuggccacuga

SEQ ID NO: 2489 - RNA, 22 nt, Artificial Sequence
  CXCR4 targeting guide RNA
caaccuccucuuugucaucacg

SEQ ID NO: 2490 - RNA, 22 nt, Artificial Sequence
  CXCR4 targeting guide RNA
caccugucaguggccaaccucc

SEQ ID NO: 2491 - RNA, 22 nt, Artificial Sequence
  CXCR4 targeting guide RNA
caguggccaaccuccucuuugu

SEQ ID NO: 2492 - RNA, 22 nt, Artificial Sequence
  CXCR4 targeting guide RNA
ccaaccuccucuuugucaucac

SEQ ID NO: 2493 - RNA, 22 nt, Artificial Sequence
  CXCR4 targeting guide RNA
ccugucaguggccaaccuccuc

SEQ ID NO: 2494 - RNA, 22 nt, Artificial Sequence
  CXCR4 targeting guide RNA
cgugaugacaaagaggagguug

SEQ ID NO: 2495 - RNA, 22 nt, Artificial Sequence
  CXCR4 targeting guide RNA
cugcaccugucaguggccaacc

SEQ ID NO: 2496 - RNA, 22 nt, Artificial Sequence
  CXCR4 targeting guide RNA
cugucaguggccaaccuccucu

SEQ ID NO: 2497 - RNA, 22 nt, Artificial Sequence
  CXCR4 targeting guide RNA
gacaaagaggagguuggccacu

SEQ ID NO: 2498 - RNA, 22 nt, Artificial Sequence
  CXCR4 targeting guide RNA
gaggagguuggccacugacagg

SEQ ID NO: 2499 - RNA, 22 nt, Artificial Sequence
  CXCR4 targeting guide RNA
gagguuggccacugacaggugc

SEQ ID NO: 2500 - RNA, 22 nt, Artificial Sequence
  CXCR4 targeting guide RNA
gaugacaaagaggagguuggcc

SEQ ID NO: 2501 - RNA, 22 nt, Artificial Sequence
  CXCR4 targeting guide RNA
gcaccugucaguggccaaccuc

SEQ ID NO: 2502 - RNA, 22 nt, Artificial Sequence
  CXCR4 targeting guide RNA
gccaaccuccucuuugucauca

SEQ ID NO: 2503 - RNA, 22 nt, Artificial Sequence
  CXCR4 targeting guide RNA
gcgugaugacaaagaggagguu

SEQ ID NO: 2504 - RNA, 22 nt, Artificial Sequence
  CXCR4 targeting guide RNA
gcugcaccugucaguggccaac

SEQ ID NO: 2505 - RNA, 22 nt, Artificial Sequence
  CXCR4 targeting guide RNA
ggagguuggccacugacaggug

SEQ ID NO: 2506 - RNA, 22 nt, Artificial Sequence
  CXCR4 targeting guide RNA
ggccaaccuccucuuugucauc

SEQ ID NO: 2507 - RNA, 22 nt, Artificial Sequence
  CXCR4 targeting guide RNA
ggcugcaccugucaguggccaa

SEQ ID NO: 2508 - RNA, 22 nt, Artificial Sequence
  CXCR4 targeting guide RNA
gguuggccacugacaggugcag

SEQ ID NO: 2509 - RNA, 22 nt, Artificial Sequence
  CXCR4 targeting guide RNA
gucaguggccaaccuccucuuu

SEQ ID NO: 2510 - RNA, 22 nt, Artificial Sequence
  CXCR4 targeting guide RNA
gugaugacaaagaggagguugg

SEQ ID NO: 2511 - RNA, 22 nt, Artificial Sequence
  CXCR4 targeting guide RNA
guggccaaccuccucuuuguca

SEQ ID NO: 2512 - RNA, 22 nt, Artificial Sequence
  CXCR4 targeting guide RNA
guuggccacugacaggugcagc

SEQ ID NO: 2513 - RNA, 22 nt, Artificial Sequence
  CXCR4 targeting guide RNA
ucaguggccaaccuccucuuug

SEQ ID NO: 2514 - RNA, 22 nt, Artificial Sequence
  CXCR4 targeting guide RNA
ugacaaagaggagguuggccac

SEQ ID NO: 2515 - RNA, 22 nt, Artificial Sequence
  CXCR4 targeting guide RNA
ugaugacaaagaggagguuggc

SEQ ID NO: 2516 - RNA, 22 nt, Artificial Sequence
  CXCR4 targeting guide RNA
ugcaccugucaguggccaaccu

SEQ ID NO: 2517 - RNA, 22 nt, Artificial Sequence
  CXCR4 targeting guide RNA
uggccaaccuccucuuugucau

SEQ ID NO: 2518 - RNA, 22 nt, Artificial Sequence
  CXCR4 targeting guide RNA
uggccacugacaggugcagccu

SEQ ID NO: 2519 - RNA, 22 nt, Artificial Sequence
  CXCR4 targeting guide RNA
ugucaguggccaaccuccucuu

SEQ ID NO: 2520 - RNA, 22 nt, Artificial Sequence
  CXCR4 targeting guide RNA
uuggccacugacaggugcagcc

SEQ ID NO: 2521 - RNA, 20 nt, Artificial Sequence
  CXCR4 targeting guide RNA
aacaggcauugugggcaaug

SEQ ID NO: 2522 - RNA, 20 nt, Artificial Sequence
  CXCR4 targeting guide RNA
aauccauugcccacaaugcc

SEQ ID NO: 2523 - RNA, 20 nt, Artificial Sequence
  CXCR4 targeting guide RNA
aaugccuguuaagaagauga

SEQ ID NO: 2524 - RNA, 20 nt, Artificial Sequence
  CXCR4 targeting guide RNA
acaaugccuguuaagaagau

SEQ ID NO: 2525 - RNA, 20 nt, Artificial Sequence
  CXCR4 targeting guide RNA
acaggcauugugggcaaugg

SEQ ID NO: 2526 - RNA, 20 nt, Artificial Sequence
  CXCR4 targeting guide RNA
acuccaucaucuucuuaaca

SEQ ID NO: 2527 - RNA, 20 nt, Artificial Sequence
  CXCR4 targeting guide RNA
aucaucuucuuaacaggcau

SEQ ID NO: 2528 - RNA, 20 nt, Artificial Sequence
  CXCR4 targeting guide RNA
auccauugcccacaaugccu

SEQ ID NO: 2529 - RNA, 20 nt, Artificial Sequence
  CXCR4 targeting guide RNA
aucuacuccaucaucuucuu

SEQ ID NO: 2530 - RNA, 20 nt, Artificial Sequence
  CXCR4 targeting guide RNA
aucuucuuaacaggcauugu

SEQ ID NO: 2531 - RNA, 20 nt, Artificial Sequence
  CXCR4 targeting guide RNA
augccuguuaagaagaugau

SEQ ID NO: 2532 - RNA, 20 nt, Artificial Sequence
  CXCR4 targeting guide RNA
auugcccacaaugccuguua

SEQ ID NO: 2533 - RNA, 20 nt, Artificial Sequence
  CXCR4 targeting guide RNA
caauccauugcccacaaugc

SEQ ID NO: 2534 - RNA, 20 nt, Artificial Sequence
  CXCR4 targeting guide RNA
caaugccuguuaagaagaug

SEQ ID NO: 2535 - RNA, 20 nt, Artificial Sequence
  CXCR4 targeting guide RNA
cacaaugccuguuaagaaga

SEQ ID NO: 2536 - RNA, 20 nt, Artificial Sequence
  CXCR4 targeting guide RNA
caggcauugugggcaaugga

SEQ ID NO: 2537 - RNA, 20 nt, Artificial Sequence
  CXCR4 targeting guide RNA
caucaucuucuuaacaggca

SEQ ID NO: 2538 - RNA, 20 nt, Artificial Sequence
  CXCR4 targeting guide RNA
caucuucuuaacaggcauug

SEQ ID NO: 2539 - RNA, 20 nt, Artificial Sequence
  CXCR4 targeting guide RNA
cauugcccacaaugccuguu

SEQ ID NO: 2540 - RNA, 20 nt, Artificial Sequence
  CXCR4 targeting guide RNA
ccaauccauugcccacaaug

SEQ ID NO: 2541 - RNA, 20 nt, Artificial Sequence
  CXCR4 targeting guide RNA
ccacaaugccuguuaagaag

SEQ ID NO: 2542 - RNA, 20 nt, Artificial Sequence
  CXCR4 targeting guide RNA
ccaucaucuucuuaacaggc

SEQ ID NO: 2543 - RNA, 20 nt, Artificial Sequence
  CXCR4 targeting guide RNA
ccauugcccacaaugccugu

SEQ ID NO: 2544 - RNA, 20 nt, Artificial Sequence
  CXCR4 targeting guide RNA
cccacaaugccuguuaagaa

SEQ ID NO: 2545 - RNA, 20 nt, Artificial Sequence
  CXCR4 targeting guide RNA
ccuguuaagaagaugaugga

SEQ ID NO: 2546 - RNA, 20 nt, Artificial Sequence
  CXCR4 targeting guide RNA
cuacuccaucaucuucuuaa

SEQ ID NO: 2547 - RNA, 20 nt, Artificial Sequence
  CXCR4 targeting guide RNA
cuccaucaucuucuuaacag

SEQ ID NO: 2548 - RNA, 20 nt, Artificial Sequence
  CXCR4 targeting guide RNA
cuguuaagaagaugauggag

SEQ ID NO: 2549 - RNA, 20 nt, Artificial Sequence
  CXCR4 targeting guide RNA
cuuaacaggcauugugggca

SEQ ID NO: 2550 - RNA, 20 nt, Artificial Sequence
  CXCR4 targeting guide RNA
cuucuuaacaggcauugugg

SEQ ID NO: 2551 - RNA, 20 nt, Artificial Sequence
  CXCR4 targeting guide RNA
gcccacaaugccuguuaaga

SEQ ID NO: 2552 - RNA, 20 nt, Artificial Sequence
  CXCR4 targeting guide RNA
gccuguuaagaagaugaugg

SEQ ID NO: 2553 - RNA, 20 nt, Artificial Sequence
  CXCR4 targeting guide RNA
uaacaggcauugugggcaau

SEQ ID NO: 2554 - RNA, 20 nt, Artificial Sequence
  CXCR4 targeting guide RNA
uacuccaucaucuucuuaac

SEQ ID NO: 2555 - RNA, 20 nt, Artificial Sequence
  CXCR4 targeting guide RNA
ucaucuucuuaacaggcauu

SEQ ID NO: 2556 - RNA, 20 nt, Artificial Sequence
  CXCR4 targeting guide RNA
uccaucaucuucuuaacagg

SEQ ID NO: 2557 - RNA, 20 nt, Artificial Sequence
  CXCR4 targeting guide RNA
uccauugcccacaaugccug

SEQ ID NO: 2558 - RNA, 20 nt, Artificial Sequence
  CXCR4 targeting guide RNA
ucuacuccaucaucuucuua

SEQ ID NO: 2559 - RNA, 20 nt, Artificial Sequence
  CXCR4 targeting guide RNA
ucuuaacaggcauugugggc

SEQ ID NO: 2560 - RNA, 20 nt, Artificial Sequence
  CXCR4 targeting guide RNA
ucuucuuaacaggcauugug

SEQ ID NO: 2561 - RNA, 20 nt, Artificial Sequence
  CXCR4 targeting guide RNA
ugcccacaaugccuguuaag

SEQ ID NO: 2562 - RNA, 20 nt, Artificial Sequence
  CXCR4 targeting guide RNA
ugccuguuaagaagaugaug

SEQ ID NO: 2563 - RNA, 20 nt, Artificial Sequence
  CXCR4 targeting guide RNA
uguuaagaagaugauggagu

SEQ ID NO: 2564 - RNA, 20 nt, Artificial Sequence
  CXCR4 targeting guide RNA
uuaacaggcauugugggcaa

SEQ ID NO: 2565 - RNA, 20 nt, Artificial Sequence
  CXCR4 targeting guide RNA
uucuuaacaggcauuguggg

SEQ ID NO: 2566 - RNA, 20 nt, Artificial Sequence
  CXCR4 targeting guide RNA
uugcccacaaugccuguuaa

SEQ ID NO: 2567 - RNA, 21 nt, Artificial Sequence
  CXCR4 targeting guide RNA
aacaggcauugugggcaaugg

SEQ ID NO: 2568 - RNA, 21 nt, Artificial Sequence
  CXCR4 targeting guide RNA
aauccauugcccacaaugccu

SEQ ID NO: 2569 - RNA, 21 nt, Artificial Sequence
  CXCR4 targeting guide RNA
aaugccuguuaagaagaugau

SEQ ID NO: 2570 - RNA, 21 nt, Artificial Sequence
  CXCR4 targeting guide RNA
acaaugccuguuaagaagaug

SEQ ID NO: 2571 - RNA, 21 nt, Artificial Sequence
  CXCR4 targeting guide RNA
acaggcauugugggcaaugga

SEQ ID NO: 2572 - RNA, 21 nt, Artificial Sequence
  CXCR4 targeting guide RNA
accaauccauugcccacaaug

SEQ ID NO: 2573 - RNA, 21 nt, Artificial Sequence
  CXCR4 targeting guide RNA
acuccaucaucuucuuaacag

SEQ ID NO: 2574 - RNA, 21 nt, Artificial Sequence
  CXCR4 targeting guide RNA
aucaucuucuuaacaggcauu

SEQ ID NO: 2575 - RNA, 21 nt, Artificial Sequence
  CXCR4 targeting guide RNA
auccauugcccacaaugccug

SEQ ID NO: 2576 - RNA, 21 nt, Artificial Sequence
  CXCR4 targeting guide RNA
aucuacuccaucaucuucuua

SEQ ID NO: 2577 - RNA, 21 nt, Artificial Sequence
  CXCR4 targeting guide RNA
aucuucuuaacaggcauugug

SEQ ID NO: 2578 - RNA, 21 nt, Artificial Sequence
  CXCR4 targeting guide RNA
augccuguuaagaagaugaug

SEQ ID NO: 2579 - RNA, 21 nt, Artificial Sequence
  CXCR4 targeting guide RNA
auugcccacaaugccuguuaa

SEQ ID NO: 2580 - RNA, 21 nt, Artificial Sequence
  CXCR4 targeting guide RNA
caauccauugcccacaaugcc

SEQ ID NO: 2581 - RNA, 21 nt, Artificial Sequence
  CXCR4 targeting guide RNA
caaugccuguuaagaagauga

SEQ ID NO: 2582 - RNA, 21 nt, Artificial Sequence
  CXCR4 targeting guide RNA
cacaaugccuguuaagaagau

SEQ ID NO: 2583 - RNA, 21 nt, Artificial Sequence
  CXCR4 targeting guide RNA
caggcauugugggcaauggau

SEQ ID NO: 2584 - RNA, 21 nt, Artificial Sequence
  CXCR4 targeting guide RNA
caucaucuucuuaacaggcau

SEQ ID NO: 2585 - RNA, 21 nt, Artificial Sequence
  CXCR4 targeting guide RNA
caucuacuccaucaucuucuu

SEQ ID NO: 2586 - RNA, 21 nt, Artificial Sequence
  CXCR4 targeting guide RNA
caucuucuuaacaggcauugu

SEQ ID NO: 2587 - RNA, 21 nt, Artificial Sequence
  CXCR4 targeting guide RNA
cauugcccacaaugccuguua

SEQ ID NO: 2588 - RNA, 21 nt, Artificial Sequence
  CXCR4 targeting guide RNA
ccaauccauugcccacaaugc

SEQ ID NO: 2589 - RNA, 21 nt, Artificial Sequence
  CXCR4 targeting guide RNA
ccacaaugccuguuaagaaga

SEQ ID NO: 2590 - RNA, 21 nt, Artificial Sequence
  CXCR4 targeting guide RNA
ccaucaucuucuuaacaggca

SEQ ID NO: 2591 - RNA, 21 nt, Artificial Sequence
  CXCR4 targeting guide RNA
ccauugcccacaaugccuguu

SEQ ID NO: 2592 - RNA, 21 nt, Artificial Sequence
  CXCR4 targeting guide RNA
cccacaaugccuguuaagaag

SEQ ID NO: 2593 - RNA, 21 nt, Artificial Sequence
  CXCR4 targeting guide RNA
ccuguuaagaagaugauggag

SEQ ID NO: 2594 - RNA, 21 nt, Artificial Sequence
  CXCR4 targeting guide RNA
cuacuccaucaucuucuuaac

SEQ ID NO: 2595 - RNA, 21 nt, Artificial Sequence
  CXCR4 targeting guide RNA
cuccaucaucuucuuaacagg

SEQ ID NO: 2596 - RNA, 21 nt, Artificial Sequence
  CXCR4 targeting guide RNA
cuguuaagaagaugauggagu

SEQ ID NO: 2597 - RNA, 21 nt, Artificial Sequence
  CXCR4 targeting guide RNA
cuuaacaggcauugugggcaa

SEQ ID NO: 2598 - RNA, 21 nt, Artificial Sequence
  CXCR4 targeting guide RNA
cuucuuaacaggcauuguggg

SEQ ID NO: 2599 - RNA, 21 nt, Artificial Sequence
  CXCR4 targeting guide RNA
gcccacaaugccuguuaagaa

SEQ ID NO: 2600 - RNA, 21 nt, Artificial Sequence
  CXCR4 targeting guide RNA
gccuguuaagaagaugaugga

SEQ ID NO: 2601 - RNA, 21 nt, Artificial Sequence
  CXCR4 targeting guide RNA
uaacaggcauugugggcaaug

SEQ ID NO: 2602 - RNA, 21 nt, Artificial Sequence
  CXCR4 targeting guide RNA
uacuccaucaucuucuuaaca

SEQ ID NO: 2603 - RNA, 21 nt, Artificial Sequence
  CXCR4 targeting guide RNA
ucaucuucuuaacaggcauug

SEQ ID NO: 2604 - RNA, 21 nt, Artificial Sequence
  CXCR4 targeting guide RNA
uccaucaucuucuuaacaggc

SEQ ID NO: 2605 - RNA, 21 nt, Artificial Sequence
  CXCR4 targeting guide RNA
uccauugcccacaaugccugu

SEQ ID NO: 2606 - RNA, 21 nt, Artificial Sequence
  CXCR4 targeting guide RNA
ucuacuccaucaucuucuuaa

SEQ ID NO: 2607 - RNA, 21 nt, Artificial Sequence
  CXCR4 targeting guide RNA
ucuuaacaggcauugugggca

SEQ ID NO: 2608 - RNA, 21 nt, Artificial Sequence
  CXCR4 targeting guide RNA
ucuucuuaacaggcauugugg

SEQ ID NO: 2609 - RNA, 21 nt, Artificial Sequence
  CXCR4 targeting guide RNA
ugcccacaaugccuguuaaga

SEQ ID NO: 2610 - RNA, 21 nt, Artificial Sequence
  CXCR4 targeting guide RNA
ugccuguuaagaagaugaugg

SEQ ID NO: 2611 - RNA, 21 nt, Artificial Sequence
  CXCR4 targeting guide RNA
uguuaagaagaugauggagua

SEQ ID NO: 2612 - RNA, 21 nt, Artificial Sequence
  CXCR4 targeting guide RNA
uuaacaggcauugugggcaau

SEQ ID NO: 2613 - RNA, 21 nt, Artificial Sequence
  CXCR4 targeting guide RNA
uucuuaacaggcauugugggc

SEQ ID NO: 2614 - RNA, 21 nt, Artificial Sequence
  CXCR4 targeting guide RNA
uugcccacaaugccuguuaag

SEQ ID NO: 2615 - RNA, 22 nt, Artificial Sequence
  CXCR4 targeting guide RNA
aacaggcauugugggcaaugga

SEQ ID NO: 2616 - RNA, 22 nt, Artificial Sequence
  CXCR4 targeting guide RNA
aauccauugcccacaaugccug

SEQ ID NO: 2617 - RNA, 22 nt, Artificial Sequence
  CXCR4 targeting guide RNA
aaugccuguuaagaagaugaug

SEQ ID NO: 2618 - RNA, 22 nt, Artificial Sequence
  CXCR4 targeting guide RNA
acaaugccuguuaagaagauga

SEQ ID NO: 2619 - RNA, 22 nt, Artificial Sequence
  CXCR4 targeting guide RNA
acaggcauugugggcaauggau

SEQ ID NO: 2620 - RNA, 22 nt, Artificial Sequence
  CXCR4 targeting guide RNA
accaauccauugcccacaaugc

SEQ ID NO: 2621 - RNA, 22 nt, Artificial Sequence
  CXCR4 targeting guide RNA
acuccaucaucuucuuaacagg

SEQ ID NO: 2622 - RNA, 22 nt, Artificial Sequence
  CXCR4 targeting guide RNA
aucaucuucuuaacaggcauug

SEQ ID NO: 2623 - RNA, 22 nt, Artificial Sequence
  CXCR4 targeting guide RNA
auccauugcccacaaugccugu

SEQ ID NO: 2624 - RNA, 22 nt, Artificial Sequence
  CXCR4 targeting guide RNA
aucuacuccaucaucuucuuaa

SEQ ID NO: 2625 - RNA, 22 nt, Artificial Sequence
  CXCR4 targeting guide RNA
aucuucuuaacaggcauugugg

SEQ ID NO: 2626 - RNA, 22 nt, Artificial Sequence
  CXCR4 targeting guide RNA
augccuguuaagaagaugaugg

SEQ ID NO: 2627 - RNA, 22 nt, Artificial Sequence
  CXCR4 targeting guide RNA
auugcccacaaugccuguuaag

SEQ ID NO: 2628 - RNA, 22 nt, Artificial Sequence
  CXCR4 targeting guide RNA
caauccauugcccacaaugccu

SEQ ID NO: 2629 - RNA, 22 nt, Artificial Sequence
  CXCR4 targeting guide RNA
caaugccuguuaagaagaugau

SEQ ID NO: 2630 - RNA, 22 nt, Artificial Sequence
  CXCR4 targeting guide RNA
cacaaugccuguuaagaagaug

SEQ ID NO: 2631 - RNA, 22 nt, Artificial Sequence
  CXCR4 targeting guide RNA
caggcauugugggcaauggauu

SEQ ID NO: 2632 - RNA, 22 nt, Artificial Sequence
  CXCR4 targeting guide RNA
caucaucuucuuaacaggcauu

SEQ ID NO: 2633 - RNA, 22 nt, Artificial Sequence
  CXCR4 targeting guide RNA
caucuacuccaucaucuucuua

SEQ ID NO: 2634 - RNA, 22 nt, Artificial Sequence
  CXCR4 targeting guide RNA
caucuucuuaacaggcauugug

SEQ ID NO: 2635 - RNA, 22 nt, Artificial Sequence
  CXCR4 targeting guide RNA
cauugcccacaaugccuguuaa

SEQ ID NO: 2636 - RNA, 22 nt, Artificial Sequence
  CXCR4 targeting guide RNA
ccaauccauugcccacaaugcc

SEQ ID NO: 2637 - RNA, 22 nt, Artificial Sequence
  CXCR4 targeting guide RNA
ccacaaugccuguuaagaagau

SEQ ID NO: 2638 - RNA, 22 nt, Artificial Sequence
  CXCR4 targeting guide RNA
ccaucaucuucuuaacaggcau

SEQ ID NO: 2639 - RNA, 22 nt, Artificial Sequence
  CXCR4 targeting guide RNA
ccaucuacuccaucaucuucuu

SEQ ID NO: 2640 - RNA, 22 nt, Artificial Sequence
  CXCR4 targeting guide RNA
ccauugcccacaaugccuguua

SEQ ID NO: 2641 - RNA, 22 nt, Artificial Sequence
  CXCR4 targeting guide RNA
cccacaaugccuguuaagaaga

SEQ ID NO: 2642 - RNA, 22 nt, Artificial Sequence
  CXCR4 targeting guide RNA
ccuguuaagaagaugauggagu

SEQ ID NO: 2643 - RNA, 22 nt, Artificial Sequence
  CXCR4 targeting guide RNA
cuacuccaucaucuucuuaaca

SEQ ID NO: 2644 - RNA, 22 nt, Artificial Sequence
  CXCR4 targeting guide RNA
cuccaucaucuucuuaacaggc

SEQ ID NO: 2645 - RNA, 22 nt, Artificial Sequence
  CXCR4 targeting guide RNA
cuguuaagaagaugauggagua

SEQ ID NO: 2646 - RNA, 22 nt, Artificial Sequence
  CXCR4 targeting guide RNA
cuuaacaggcauugugggcaau

SEQ ID NO: 2647 - RNA, 22 nt, Artificial Sequence
  CXCR4 targeting guide RNA
cuucuuaacaggcauugugggc

SEQ ID NO: 2648 - RNA, 22 nt, Artificial Sequence
  CXCR4 targeting guide RNA
gaccaauccauugcccacaaug

SEQ ID NO: 2649 - RNA, 22 nt, Artificial Sequence
  CXCR4 targeting guide RNA
gcccacaaugccuguuaagaag

SEQ ID NO: 2650 - RNA, 22 nt, Artificial Sequence
  CXCR4 targeting guide RNA
gccuguuaagaagaugauggag

SEQ ID NO: 2651 - RNA, 22 nt, Artificial Sequence
  CXCR4 targeting guide RNA
uaacaggcauugugggcaaugg

SEQ ID NO: 2652 - RNA, 22 nt, Artificial Sequence
  CXCR4 targeting guide RNA
uacuccaucaucuucuuaacag

SEQ ID NO: 2653 - RNA, 22 nt, Artificial Sequence
  CXCR4 targeting guide RNA
ucaucuucuuaacaggcauugu

SEQ ID NO: 2654 - RNA, 22 nt, Artificial Sequence
  CXCR4 targeting guide RNA
uccaucaucuucuuaacaggca

SEQ ID NO: 2655 - RNA, 22 nt, Artificial Sequence
  CXCR4 targeting guide RNA
uccauugcccacaaugccuguu

SEQ ID NO: 2656 - RNA, 22 nt, Artificial Sequence
  CXCR4 targeting guide RNA
ucuacuccaucaucuucuuaac

SEQ ID NO: 2657 - RNA, 22 nt, Artificial Sequence
  CXCR4 targeting guide RNA
ucuuaacaggcauugugggcaa

SEQ ID NO: 2658 - RNA, 22 nt, Artificial Sequence
  CXCR4 targeting guide RNA
ucuucuuaacaggcauuguggg

SEQ ID NO: 2659 - RNA, 22 nt, Artificial Sequence
  CXCR4 targeting guide RNA
ugcccacaaugccuguuaagaa

SEQ ID NO: 2660 - RNA, 22 nt, Artificial Sequence
  CXCR4 targeting guide RNA
ugccuguuaagaagaugaugga

SEQ ID NO: 2661 - RNA, 22 nt, Artificial Sequence
  CXCR4 targeting guide RNA
uguuaagaagaugauggaguag

SEQ ID NO: 2662 - RNA, 22 nt, Artificial Sequence
  CXCR4 targeting guide RNA
uuaacaggcauugugggcaaug

SEQ ID NO: 2663 - RNA, 22 nt, Artificial Sequence
  CXCR4 targeting guide RNA
uucuuaacaggcauugugggca

SEQ ID NO: 2664 - RNA, 22 nt, Artificial Sequence
  CXCR4 targeting guide RNA
uugcccacaaugccuguuaaga

SEQ ID NO: 2665 - RNA, 20 nt, Artificial Sequence
  CXCR4 targeting guide RNA
aaaagaggcuaaggaaugga

SEQ ID NO: 2666 - RNA, 20 nt, Artificial Sequence
  CXCR4 targeting guide RNA
aaagaggcuaaggaauggac

SEQ ID NO: 2667 - RNA, 20 nt, Artificial Sequence
  CXCR4 targeting guide RNA
aagaggcuaaggaauggaca

SEQ ID NO: 2668 - RNA, 20 nt, Artificial Sequence
  CXCR4 targeting guide RNA
aagugaauguccauuccuua

SEQ ID NO: 2669 - RNA, 20 nt, Artificial Sequence
  CXCR4 targeting guide RNA
aauguccauuccuuagccuc

SEQ ID NO: 2670 - RNA, 20 nt, Artificial Sequence
  CXCR4 targeting guide RNA
agaggcuaaggaauggacau

SEQ ID NO: 2671 - RNA, 20 nt, Artificial Sequence
  CXCR4 targeting guide RNA
aggcuaaggaauggacauuc

SEQ ID NO: 2672 - RNA, 20 nt, Artificial Sequence
  CXCR4 targeting guide RNA
agugaauguccauuccuuag

SEQ ID NO: 2673 - RNA, 20 nt, Artificial Sequence
  CXCR4 targeting guide RNA
aguguauaucugcaaaagag

SEQ ID NO: 2674 - RNA, 20 nt, Artificial Sequence
  CXCR4 targeting guide RNA
auaucugcaaaagaggcuaa

SEQ ID NO: 2675 - RNA, 20 nt, Artificial Sequence
  CXCR4 targeting guide RNA
aucugcaaaagaggcuaagg

SEQ ID NO: 2676 - RNA, 20 nt, Artificial Sequence
  CXCR4 targeting guide RNA
auguccauuccuuagccucu

SEQ ID NO: 2677 - RNA, 20 nt, Artificial Sequence
  CXCR4 targeting guide RNA
auuccuuagccucuuuugca

SEQ ID NO: 2678 - RNA, 20 nt, Artificial Sequence
  CXCR4 targeting guide RNA
caaaagaggcuaaggaaugg

SEQ ID NO: 2679 - RNA, 20 nt, Artificial Sequence
  CXCR4 targeting guide RNA
cauuccuuagccucuuuugc

SEQ ID NO: 2680 - RNA, 20 nt, Artificial Sequence
  CXCR4 targeting guide RNA
ccauuccuuagccucuuuug

SEQ ID NO: 2681 - RNA, 20 nt, Artificial Sequence
  CXCR4 targeting guide RNA
ccuuagccucuuuugcagau

SEQ ID NO: 2682 - RNA, 20 nt, Artificial Sequence
  CXCR4 targeting guide RNA
cuaaggaauggacauucacu

SEQ ID NO: 2683 - RNA, 20 nt, Artificial Sequence
  CXCR4 targeting guide RNA
cugcaaaagaggcuaaggaa

SEQ ID NO: 2684 - RNA, 20 nt, Artificial Sequence
  CXCR4 targeting guide RNA
cuuagccucuuuugcagaua

SEQ ID NO: 2685 - RNA, 20 nt, Artificial Sequence
  CXCR4 targeting guide RNA
gaagugaauguccauuccuu

SEQ ID NO: 2686 - RNA, 20 nt, Artificial Sequence
  CXCR4 targeting guide RNA
gaauguccauuccuuagccu

SEQ ID NO: 2687 - RNA, 20 nt, Artificial Sequence
  CXCR4 targeting guide RNA
gaggcuaaggaauggacauu

SEQ ID NO: 2688 - RNA, 20 nt, Artificial Sequence
  CXCR4 targeting guide RNA
gcaaaagaggcuaaggaaug

SEQ ID NO: 2689 - RNA, 20 nt, Artificial Sequence
  CXCR4 targeting guide RNA
gcuaaggaauggacauucac

SEQ ID NO: 2690 - RNA, 20 nt, Artificial Sequence
  CXCR4 targeting guide RNA
ggaagugaauguccauuccu

SEQ ID NO: 2691 - RNA, 20 nt, Artificial Sequence
  CXCR4 targeting guide RNA
ggcuaaggaauggacauuca

SEQ ID NO: 2692 - RNA, 20 nt, Artificial Sequence
  CXCR4 targeting guide RNA
guauaucugcaaaagaggcu

SEQ ID NO: 2693 - RNA, 20 nt, Artificial Sequence
  CXCR4 targeting guide RNA
guccauuccuuagccucuuu

SEQ ID NO: 2694 - RNA, 20 nt, Artificial Sequence
  CXCR4 targeting guide RNA
gugaauguccauuccuuagc

SEQ ID NO: 2695 - RNA, 20 nt, Artificial Sequence
  CXCR4 targeting guide RNA
guguauaucugcaaaagagg

SEQ ID NO: 2696 - RNA, 20 nt, Artificial Sequence
  CXCR4 targeting guide RNA
uaaggaauggacauucacuu

SEQ ID NO: 2697 - RNA, 20 nt, Artificial Sequence
  CXCR4 targeting guide RNA
uagccucuuuugcagauaua

SEQ ID NO: 2698 - RNA, 20 nt, Artificial Sequence
  CXCR4 targeting guide RNA
uauaucugcaaaagaggcua

SEQ ID NO: 2699 - RNA, 20 nt, Artificial Sequence
  CXCR4 targeting guide RNA
uaucugcaaaagaggcuaag

SEQ ID NO: 2700 - RNA, 20 nt, Artificial Sequence
  CXCR4 targeting guide RNA
uccauuccuuagccucuuuu

SEQ ID NO: 2701 - RNA, 20 nt, Artificial Sequence
  CXCR4 targeting guide RNA
uccuuagccucuuuugcaga

SEQ ID NO: 2702 - RNA, 20 nt, Artificial Sequence
  CXCR4 targeting guide RNA
ucugcaaaagaggcuaagga

SEQ ID NO: 2703 - RNA, 20 nt, Artificial Sequence
  CXCR4 targeting guide RNA
ugaauguccauuccuuagcc

SEQ ID NO: 2704 - RNA, 20 nt, Artificial Sequence
  CXCR4 targeting guide RNA
ugcaaaagaggcuaaggaau

SEQ ID NO: 2705 - RNA, 20 nt, Artificial Sequence
  CXCR4 targeting guide RNA
uggaagugaauguccauucc

SEQ ID NO: 2706 - RNA, 20 nt, Artificial Sequence
  CXCR4 targeting guide RNA
uguauaucugcaaaagaggc

SEQ ID NO: 2707 - RNA, 20 nt, Artificial Sequence
  CXCR4 targeting guide RNA
uguccauuccuuagccucuu

SEQ ID NO: 2708 - RNA, 20 nt, Artificial Sequence
  CXCR4 targeting guide RNA
uuagccucuuuugcagauau

SEQ ID NO: 2709 - RNA, 20 nt, Artificial Sequence
  CXCR4 targeting guide RNA
uuccuuagccucuuuugcag

SEQ ID NO: 2710 - RNA, 20 nt, Artificial Sequence
  CXCR4 targeting guide RNA
uuggaagugaauguccauuc

SEQ ID NO: 2711 - RNA, 21 nt, Artificial Sequence
  CXCR4 targeting guide RNA
aaaagaggcuaaggaauggac

SEQ ID NO: 2712 - RNA, 21 nt, Artificial Sequence
  CXCR4 targeting guide RNA
aaagaggcuaaggaauggaca

SEQ ID NO: 2713 - RNA, 21 nt, Artificial Sequence
  CXCR4 targeting guide RNA
aagaggcuaaggaauggacau

SEQ ID NO: 2714 - RNA, 21 nt, Artificial Sequence
  CXCR4 targeting guide RNA
aagugaauguccauuccuuag

SEQ ID NO: 2715 - RNA, 21 nt, Artificial Sequence
  CXCR4 targeting guide RNA
aaguguauaucugcaaaagag

SEQ ID NO: 2716 - RNA, 21 nt, Artificial Sequence
  CXCR4 targeting guide RNA
aauguccauuccuuagccucu

SEQ ID NO: 2717 - RNA, 21 nt, Artificial Sequence
  CXCR4 targeting guide RNA
agaggcuaaggaauggacauu

SEQ ID NO: 2718 - RNA, 21 nt, Artificial Sequence
  CXCR4 targeting guide RNA
aggcuaaggaauggacauuca

SEQ ID NO: 2719 - RNA, 21 nt, Artificial Sequence
  CXCR4 targeting guide RNA
agugaauguccauuccuuagc

SEQ ID NO: 2720 - RNA, 21 nt, Artificial Sequence
  CXCR4 targeting guide RNA
aguguauaucugcaaaagagg

SEQ ID NO: 2721 - RNA, 21 nt, Artificial Sequence
  CXCR4 targeting guide RNA
auaucugcaaaagaggcuaag

SEQ ID NO: 2722 - RNA, 21 nt, Artificial Sequence
  CXCR4 targeting guide RNA
aucugcaaaagaggcuaagga

SEQ ID NO: 2723 - RNA, 21 nt, Artificial Sequence
  CXCR4 targeting guide RNA
auguccauuccuuagccucuu

SEQ ID NO: 2724 - RNA, 21 nt, Artificial Sequence
  CXCR4 targeting guide RNA
auuccuuagccucuuuugcag

SEQ ID NO: 2725 - RNA, 21 nt, Artificial Sequence
  CXCR4 targeting guide RNA
auuggaagugaauguccauuc

SEQ ID NO: 2726 - RNA, 21 nt, Artificial Sequence
  CXCR4 targeting guide RNA
caaaagaggcuaaggaaugga

SEQ ID NO: 2727 - RNA, 21 nt, Artificial Sequence
  CXCR4 targeting guide RNA
cauuccuuagccucuuuugca

SEQ ID NO: 2728 - RNA, 21 nt, Artificial Sequence
  CXCR4 targeting guide RNA
ccauuccuuagccucuuuugc

SEQ ID NO: 2729 - RNA, 21 nt, Artificial Sequence
  CXCR4 targeting guide RNA
ccuuagccucuuuugcagaua

SEQ ID NO: 2730 - RNA, 21 nt, Artificial Sequence
  CXCR4 targeting guide RNA
cuaaggaauggacauucacuu

SEQ ID NO: 2731 - RNA, 21 nt, Artificial Sequence
  CXCR4 targeting guide RNA
cugcaaaagaggcuaaggaau

SEQ ID NO: 2732 - RNA, 21 nt, Artificial Sequence
  CXCR4 targeting guide RNA
cuuagccucuuuugcagauau

SEQ ID NO: 2733 - RNA, 21 nt, Artificial Sequence
  CXCR4 targeting guide RNA
gaagugaauguccauuccuua

SEQ ID NO: 2734 - RNA, 21 nt, Artificial Sequence
  CXCR4 targeting guide RNA
gaauguccauuccuuagccuc

SEQ ID NO: 2735 - RNA, 21 nt, Artificial Sequence
  CXCR4 targeting guide RNA
gaggcuaaggaauggacauuc

SEQ ID NO: 2736 - RNA, 21 nt, Artificial Sequence
  CXCR4 targeting guide RNA
gcaaaagaggcuaaggaaugg

SEQ ID NO: 2737 - RNA, 21 nt, Artificial Sequence
  CXCR4 targeting guide RNA
gcuaaggaauggacauucacu

SEQ ID NO: 2738 - RNA, 21 nt, Artificial Sequence
  CXCR4 targeting guide RNA
ggaagugaauguccauuccuu

SEQ ID NO: 2739 - RNA, 21 nt, Artificial Sequence
  CXCR4 targeting guide RNA
ggcuaaggaauggacauucac

SEQ ID NO: 2740 - RNA, 21 nt, Artificial Sequence
  CXCR4 targeting guide RNA
guauaucugcaaaagaggcua

SEQ ID NO: 2741 - RNA, 21 nt, Artificial Sequence
  CXCR4 targeting guide RNA
guccauuccuuagccucuuuu

SEQ ID NO: 2742 - RNA, 21 nt, Artificial Sequence
  CXCR4 targeting guide RNA
gugaauguccauuccuuagcc

SEQ ID NO: 2743 - RNA, 21 nt, Artificial Sequence
  CXCR4 targeting guide RNA
guguauaucugcaaaagaggc

SEQ ID NO: 2744 - RNA, 21 nt, Artificial Sequence
  CXCR4 targeting guide RNA
uaaggaauggacauucacuuc

SEQ ID NO: 2745 - RNA, 21 nt, Artificial Sequence
  CXCR4 targeting guide RNA
uagccucuuuugcagauauac

SEQ ID NO: 2746 - RNA, 21 nt, Artificial Sequence
  CXCR4 targeting guide RNA
uauaucugcaaaagaggcuaa

SEQ ID NO: 2747 - RNA, 21 nt, Artificial Sequence
  CXCR4 targeting guide RNA
uaucugcaaaagaggcuaagg

SEQ ID NO: 2748 - RNA, 21 nt, Artificial Sequence
  CXCR4 targeting guide RNA
uccauuccuuagccucuuuug

SEQ ID NO: 2749 - RNA, 21 nt, Artificial Sequence
  CXCR4 targeting guide RNA
uccuuagccucuuuugcagau

SEQ ID NO: 2750 - RNA, 21 nt, Artificial Sequence
  CXCR4 targeting guide RNA
ucugcaaaagaggcuaaggaa

SEQ ID NO: 2751 - RNA, 21 nt, Artificial Sequence
  CXCR4 targeting guide RNA
ugaauguccauuccuuagccu

SEQ ID NO: 2752 - RNA, 21 nt, Artificial Sequence
  CXCR4 targeting guide RNA
ugcaaaagaggcuaaggaaug

SEQ ID NO: 2753 - RNA, 21 nt, Artificial Sequence
  CXCR4 targeting guide RNA
uggaagugaauguccauuccu

SEQ ID NO: 2754 - RNA, 21 nt, Artificial Sequence
  CXCR4 targeting guide RNA
uguauaucugcaaaagaggcu

SEQ ID NO: 2755 - RNA, 21 nt, Artificial Sequence
  CXCR4 targeting guide RNA
uguccauuccuuagccucuuu

SEQ ID NO: 2756 - RNA, 21 nt, Artificial Sequence
  CXCR4 targeting guide RNA
uuagccucuuuugcagauaua

SEQ ID NO: 2757 - RNA, 21 nt, Artificial Sequence
  CXCR4 targeting guide RNA
uuccuuagccucuuuugcaga

SEQ ID NO: 2758 - RNA, 21 nt, Artificial Sequence
  CXCR4 targeting guide RNA
uuggaagugaauguccauucc

SEQ ID NO: 2759 - RNA, 22 nt, Artificial Sequence
  CXCR4 targeting guide RNA
aaaagaggcuaaggaauggaca

SEQ ID NO: 2760 - RNA, 22 nt, Artificial Sequence
  CXCR4 targeting guide RNA
aaagaggcuaaggaauggacau

SEQ ID NO: 2761 - RNA, 22 nt, Artificial Sequence
  CXCR4 targeting guide RNA
aagaggcuaaggaauggacauu

SEQ ID NO: 2762 - RNA, 22 nt, Artificial Sequence
  CXCR4 targeting guide RNA
aagugaauguccauuccuuagc

SEQ ID NO: 2763 - RNA, 22 nt, Artificial Sequence
  CXCR4 targeting guide RNA
aaguguauaucugcaaaagagg

SEQ ID NO: 2764 - RNA, 22 nt, Artificial Sequence
  CXCR4 targeting guide RNA
aauguccauuccuuagccucuu

SEQ ID NO: 2765 - RNA, 22 nt, Artificial Sequence
  CXCR4 targeting guide RNA
aauuggaagugaauguccauuc

SEQ ID NO: 2766 - RNA, 22 nt, Artificial Sequence
  CXCR4 targeting guide RNA
agaggcuaaggaauggacauuc

SEQ ID NO: 2767 - RNA, 22 nt, Artificial Sequence
  CXCR4 targeting guide RNA
aggcuaaggaauggacauucac

SEQ ID NO: 2768 - RNA, 22 nt, Artificial Sequence
  CXCR4 targeting guide RNA
agugaauguccauuccuuagcc

SEQ ID NO: 2769 - RNA, 22 nt, Artificial Sequence
  CXCR4 targeting guide RNA
aguguauaucugcaaaagaggc

SEQ ID NO: 2770 - RNA, 22 nt, Artificial Sequence
  CXCR4 targeting guide RNA
auaucugcaaaagaggcuaagg

SEQ ID NO: 2771 - RNA, 22 nt, Artificial Sequence
  CXCR4 targeting guide RNA
aucugcaaaagaggcuaaggaa

SEQ ID NO: 2772 - RNA, 22 nt, Artificial Sequence
  CXCR4 targeting guide RNA
auguccauuccuuagccucuuu

SEQ ID NO: 2773 - RNA, 22 nt, Artificial Sequence
  CXCR4 targeting guide RNA
auuccuuagccucuuuugcaga

SEQ ID NO: 2774 - RNA, 22 nt, Artificial Sequence
  CXCR4 targeting guide RNA
auuggaagugaauguccauucc

SEQ ID NO: 2775 - RNA, 22 nt, Artificial Sequence
  CXCR4 targeting guide RNA
caaaagaggcuaaggaauggac

SEQ ID NO: 2776 - RNA, 22 nt, Artificial Sequence
  CXCR4 targeting guide RNA
cauuccuuagccucuuuugcag

SEQ ID NO: 2777 - RNA, 22 nt, Artificial Sequence
  CXCR4 targeting guide RNA
ccauuccuuagccucuuuugca

SEQ ID NO: 2778 - RNA, 22 nt, Artificial Sequence
  CXCR4 targeting guide RNA
ccuuagccucuuuugcagauau

SEQ ID NO: 2779 - RNA, 22 nt, Artificial Sequence
  CXCR4 targeting guide RNA
cuaaggaauggacauucacuuc

SEQ ID NO: 2780 - RNA, 22 nt, Artificial Sequence
  CXCR4 targeting guide RNA
cugcaaaagaggcuaaggaaug

SEQ ID NO: 2781 - RNA, 22 nt, Artificial Sequence
  CXCR4 targeting guide RNA
cuuagccucuuuugcagauaua

SEQ ID NO: 2782 - RNA, 22 nt, Artificial Sequence
  CXCR4 targeting guide RNA
gaagugaauguccauuccuuag

SEQ ID NO: 2783 - RNA, 22 nt, Artificial Sequence
  CXCR4 targeting guide RNA
gaaguguauaucugcaaaagag

SEQ ID NO: 2784 - RNA, 22 nt, Artificial Sequence
  CXCR4 targeting guide RNA
gaauguccauuccuuagccucu

SEQ ID NO: 2785 - RNA, 22 nt, Artificial Sequence
  CXCR4 targeting guide RNA
gaggcuaaggaauggacauuca

SEQ ID NO: 2786 - RNA, 22 nt, Artificial Sequence
  CXCR4 targeting guide RNA
gcaaaagaggcuaaggaaugga

SEQ ID NO: 2787 - RNA, 22 nt, Artificial Sequence
  CXCR4 targeting guide RNA
gcuaaggaauggacauucacuu

SEQ ID NO: 2788 - RNA, 22 nt, Artificial Sequence
  CXCR4 targeting guide RNA
ggaagugaauguccauuccuua

SEQ ID NO: 2789 - RNA, 22 nt, Artificial Sequence
  CXCR4 targeting guide RNA
ggcuaaggaauggacauucacu

SEQ ID NO: 2790 - RNA, 22 nt, Artificial Sequence
  CXCR4 targeting guide RNA
guauaucugcaaaagaggcuaa

SEQ ID NO: 2791 - RNA, 22 nt, Artificial Sequence
  CXCR4 targeting guide RNA
guccauuccuuagccucuuuug

SEQ ID NO: 2792 - RNA, 22 nt, Artificial Sequence
  CXCR4 targeting guide RNA
gugaauguccauuccuuagccu

SEQ ID NO: 2793 - RNA, 22 nt, Artificial Sequence
  CXCR4 targeting guide RNA
guguauaucugcaaaagaggcu

SEQ ID NO: 2794 - RNA, 22 nt, Artificial Sequence
  CXCR4 targeting guide RNA
uaaggaauggacauucacuucc

SEQ ID NO: 2795 - RNA, 22 nt, Artificial Sequence
  CXCR4 targeting guide RNA
uagccucuuuugcagauauaca

SEQ ID NO: 2796 - RNA, 22 nt, Artificial Sequence
  CXCR4 targeting guide RNA
uauaucugcaaaagaggcuaag

SEQ ID NO: 2797 - RNA, 22 nt, Artificial Sequence
  CXCR4 targeting guide RNA
uaucugcaaaagaggcuaagga

SEQ ID NO: 2798 - RNA, 22 nt, Artificial Sequence
  CXCR4 targeting guide RNA
uccauuccuuagccucuuuugc

SEQ ID NO: 2799 - RNA, 22 nt, Artificial Sequence
  CXCR4 targeting guide RNA
uccuuagccucuuuugcagaua

SEQ ID NO: 2800 - RNA, 22 nt, Artificial Sequence
  CXCR4 targeting guide RNA
ucugcaaaagaggcuaaggaau

SEQ ID NO: 2801 - RNA, 22 nt, Artificial Sequence
  CXCR4 targeting guide RNA
ugaauguccauuccuuagccuc

SEQ ID NO: 2802 - RNA, 22 nt, Artificial Sequence
  CXCR4 targeting guide RNA
ugcaaaagaggcuaaggaaugg

SEQ ID NO: 2803 - RNA, 22 nt, Artificial Sequence
  CXCR4 targeting guide RNA
uggaagugaauguccauuccuu

SEQ ID NO: 2804 - RNA, 22 nt, Artificial Sequence
  CXCR4 targeting guide RNA
uguauaucugcaaaagaggcua

SEQ ID NO: 2805 - RNA, 22 nt, Artificial Sequence
  CXCR4 targeting guide RNA
uguccauuccuuagccucuuuu

SEQ ID NO: 2806 - RNA, 22 nt, Artificial Sequence
  CXCR4 targeting guide RNA
uuagccucuuuugcagauauac

SEQ ID NO: 2807 - RNA, 22 nt, Artificial Sequence
  CXCR4 targeting guide RNA
uuccuuagccucuuuugcagau

SEQ ID NO: 2808 - RNA, 22 nt, Artificial Sequence
  CXCR4 targeting guide RNA
uuggaagugaauguccauuccu

SEQ ID NO: 2809 - RNA, 20 nt, Artificial Sequence
  CXCR4 targeting guide RNA
aaaacaaaggcuuugcaaga

SEQ ID NO: 2810 - RNA, 20 nt, Artificial Sequence
  CXCR4 targeting guide RNA
aaacaaaggcuuugcaagag

SEQ ID NO: 2811 - RNA, 20 nt, Artificial Sequence
  CXCR4 targeting guide RNA
aaaggcuuugcaagagaaaa

SEQ ID NO: 2812 - RNA, 20 nt, Artificial Sequence
  CXCR4 targeting guide RNA
aaaguggauguuuucucuug

SEQ ID NO: 2813 - RNA, 20 nt, Artificial Sequence
  CXCR4 targeting guide RNA
aacaaaggcuuugcaagaga

SEQ ID NO: 2814 - RNA, 20 nt, Artificial Sequence
  CXCR4 targeting guide RNA
aagagaaaacauccacuuuc

SEQ ID NO: 2815 - RNA, 20 nt, Artificial Sequence
  CXCR4 targeting guide RNA
aaggcuuugcaagagaaaac

SEQ ID NO: 2816 - RNA, 20 nt, Artificial Sequence
  CXCR4 targeting guide RNA
aaguggauguuuucucuugc

SEQ ID NO: 2817 - RNA, 20 nt, Artificial Sequence
  CXCR4 targeting guide RNA
acaaaggcuuugcaagagaa

SEQ ID NO: 2818 - RNA, 20 nt, Artificial Sequence
  CXCR4 targeting guide RNA
agaaaacauccacuuucccc

SEQ ID NO: 2819 - RNA, 20 nt, Artificial Sequence
  CXCR4 targeting guide RNA
agagaaaacauccacuuucc

SEQ ID NO: 2820 - RNA, 20 nt, Artificial Sequence
  CXCR4 targeting guide RNA
aggcuuugcaagagaaaaca

SEQ ID NO: 2821 - RNA, 20 nt, Artificial Sequence
  CXCR4 targeting guide RNA
aggggggaaaguggauguuu

SEQ ID NO: 2822 - RNA, 20 nt, Artificial Sequence
  CXCR4 targeting guide RNA
aguggauguuuucucuugca

SEQ ID NO: 2823 - RNA, 20 nt, Artificial Sequence
  CXCR4 targeting guide RNA
auguuuucucuugcaaagcc

SEQ ID NO: 2824 - RNA, 20 nt, Artificial Sequence
  CXCR4 targeting guide RNA
caaaggcuuugcaagagaaa

SEQ ID NO: 2825 - RNA, 20 nt, Artificial Sequence
  CXCR4 targeting guide RNA
caagagaaaacauccacuuu

SEQ ID NO: 2826 - RNA, 20 nt, Artificial Sequence
  CXCR4 targeting guide RNA
cuaggggggaaaguggaugu

SEQ ID NO: 2827 - RNA, 20 nt, Artificial Sequence
  CXCR4 targeting guide RNA
cuuugcaagagaaaacaucc

SEQ ID NO: 2828 - RNA, 20 nt, Artificial Sequence
  CXCR4 targeting guide RNA
gaaaacaaaggcuuugcaag

SEQ ID NO: 2829 - RNA, 20 nt, Artificial Sequence
  CXCR4 targeting guide RNA
gaaaacauccacuuuccccc

SEQ ID NO: 2830 - RNA, 20 nt, Artificial Sequence
  CXCR4 targeting guide RNA
gaaaguggauguuuucucuu

SEQ ID NO: 2831 - RNA, 20 nt, Artificial Sequence
  CXCR4 targeting guide RNA
gagaaaacauccacuuuccc

SEQ ID NO: 2832 - RNA, 20 nt, Artificial Sequence
  CXCR4 targeting guide RNA
gauguuuucucuugcaaagc

SEQ ID NO: 2833 - RNA, 20 nt, Artificial Sequence
  CXCR4 targeting guide RNA
gcaagagaaaacauccacuu

SEQ ID NO: 2834 - RNA, 20 nt, Artificial Sequence
  CXCR4 targeting guide RNA
gcuuugcaagagaaaacauc

SEQ ID NO: 2835 - RNA, 20 nt, Artificial Sequence
  CXCR4 targeting guide RNA
ggaaaacaaaggcuuugcaa

SEQ ID NO: 2836 - RNA, 20 nt, Artificial Sequence
  CXCR4 targeting guide RNA
ggaaaguggauguuuucucu

SEQ ID NO: 2837 - RNA, 20 nt, Artificial Sequence
  CXCR4 targeting guide RNA
ggauguuuucucuugcaaag

SEQ ID NO: 2838 - RNA, 20 nt, Artificial Sequence
  CXCR4 targeting guide RNA
ggcuuugcaagagaaaacau

SEQ ID NO: 2839 - RNA, 20 nt, Artificial Sequence
  CXCR4 targeting guide RNA
gggaaaguggauguuuucuc

SEQ ID NO: 2840 - RNA, 20 nt, Artificial Sequence
  CXCR4 targeting guide RNA
ggggaaaguggauguuuucu

SEQ ID NO: 2841 - RNA, 20 nt, Artificial Sequence
  CXCR4 targeting guide RNA
gggggaaaguggauguuuuc

SEQ ID NO: 2842 - RNA, 20 nt, Artificial Sequence
  CXCR4 targeting guide RNA
ggggggaaaguggauguuuu

SEQ ID NO: 2843 - RNA, 20 nt, Artificial Sequence
  CXCR4 targeting guide RNA
guggauguuuucucuugcaa

SEQ ID NO: 2844 - RNA, 20 nt, Artificial Sequence
  CXCR4 targeting guide RNA
guuuucucuugcaaagccuu

SEQ ID NO: 2845 - RNA, 20 nt, Artificial Sequence
  CXCR4 targeting guide RNA
uaggggggaaaguggauguu

SEQ ID NO: 2846 - RNA, 20 nt, Artificial Sequence
  CXCR4 targeting guide RNA
ucucuugcaaagccuuuguu

SEQ ID NO: 2847 - RNA, 20 nt, Artificial Sequence
  CXCR4 targeting guide RNA
ugcaagagaaaacauccacu

SEQ ID NO: 2848 - RNA, 20 nt, Artificial Sequence
  CXCR4 targeting guide RNA
uggauguuuucucuugcaaa

SEQ ID NO: 2849 - RNA, 20 nt, Artificial Sequence
  CXCR4 targeting guide RNA
uguuuucucuugcaaagccu

SEQ ID NO: 2850 - RNA, 20 nt, Artificial Sequence
  CXCR4 targeting guide RNA
uucucuugcaaagccuuugu

SEQ ID NO: 2851 - RNA, 20 nt, Artificial Sequence
  CXCR4 targeting guide RNA
uugcaagagaaaacauccac

SEQ ID NO: 2852 - RNA, 20 nt, Artificial Sequence
  CXCR4 targeting guide RNA
uuucucuugcaaagccuuug

SEQ ID NO: 2853 - RNA, 20 nt, Artificial Sequence
  CXCR4 targeting guide RNA
uuugcaagagaaaacaucca

SEQ ID NO: 2854 - RNA, 20 nt, Artificial Sequence
  CXCR4 targeting guide RNA
uuuucucuugcaaagccuuu

SEQ ID NO: 2855 - RNA, 21 nt, Artificial Sequence
  CXCR4 targeting guide RNA
aaaacaaaggcuuugcaagag

SEQ ID NO: 2856 - RNA, 21 nt, Artificial Sequence
  CXCR4 targeting guide RNA
aaacaaaggcuuugcaagaga

SEQ ID NO: 2857 - RNA, 21 nt, Artificial Sequence
  CXCR4 targeting guide RNA
aaaggcuuugcaagagaaaac

SEQ ID NO: 2858 - RNA, 21 nt, Artificial Sequence
  CXCR4 targeting guide RNA
aaaguggauguuuucucuugc

SEQ ID NO: 2859 - RNA, 21 nt, Artificial Sequence
  CXCR4 targeting guide RNA
aacaaaggcuuugcaagagaa

SEQ ID NO: 2860 - RNA, 21 nt, Artificial Sequence
  CXCR4 targeting guide RNA
aagagaaaacauccacuuucc

SEQ ID NO: 2861 - RNA, 21 nt, Artificial Sequence
  CXCR4 targeting guide RNA
aaggcuuugcaagagaaaaca

SEQ ID NO: 2862 - RNA, 21 nt, Artificial Sequence
  CXCR4 targeting guide RNA
aaguggauguuuucucuugca

SEQ ID NO: 2863 - RNA, 21 nt, Artificial Sequence
  CXCR4 targeting guide RNA
acaaaggcuuugcaagagaaa

SEQ ID NO: 2864 - RNA, 21 nt, Artificial Sequence
  CXCR4 targeting guide RNA
acuaggggggaaaguggaugu

SEQ ID NO: 2865 - RNA, 21 nt, Artificial Sequence
  CXCR4 targeting guide RNA
agaaaacauccacuuuccccc

SEQ ID NO: 2866 - RNA, 21 nt, Artificial Sequence
  CXCR4 targeting guide RNA
agagaaaacauccacuuuccc

SEQ ID NO: 2867 - RNA, 21 nt, Artificial Sequence
  CXCR4 targeting guide RNA
aggaaaacaaaggcuuugcaa

SEQ ID NO: 2868 - RNA, 21 nt, Artificial Sequence
  CXCR4 targeting guide RNA
aggcuuugcaagagaaaacau

SEQ ID NO: 2869 - RNA, 21 nt, Artificial Sequence
  CXCR4 targeting guide RNA
aggggggaaaguggauguuuu

SEQ ID NO: 2870 - RNA, 21 nt, Artificial Sequence
  CXCR4 targeting guide RNA
aguggauguuuucucuugcaa

SEQ ID NO: 2871 - RNA, 21 nt, Artificial Sequence
  CXCR4 targeting guide RNA
auguuuucucuugcaaagccu

SEQ ID NO: 2872 - RNA, 21 nt, Artificial Sequence
  CXCR4 targeting guide RNA
caaaggcuuugcaagagaaaa

SEQ ID NO: 2873 - RNA, 21 nt, Artificial Sequence
  CXCR4 targeting guide RNA
caagagaaaacauccacuuuc

SEQ ID NO: 2874 - RNA, 21 nt, Artificial Sequence
  CXCR4 targeting guide RNA
cuaggggggaaaguggauguu

SEQ ID NO: 2875 - RNA, 21 nt, Artificial Sequence
  CXCR4 targeting guide RNA
cuuugcaagagaaaacaucca

SEQ ID NO: 2876 - RNA, 21 nt, Artificial Sequence
  CXCR4 targeting guide RNA
gaaaacaaaggcuuugcaaga

SEQ ID NO: 2877 - RNA, 21 nt, Artificial Sequence
  CXCR4 targeting guide RNA
gaaaacauccacuuucccccc

SEQ ID NO: 2878 - RNA, 21 nt, Artificial Sequence
  CXCR4 targeting guide RNA
gaaaguggauguuuucucuug

SEQ ID NO: 2879 - RNA, 21 nt, Artificial Sequence
  CXCR4 targeting guide RNA
gagaaaacauccacuuucccc

SEQ ID NO: 2880 - RNA, 21 nt, Artificial Sequence
  CXCR4 targeting guide RNA
gauguuuucucuugcaaagcc

SEQ ID NO: 2881 - RNA, 21 nt, Artificial Sequence
  CXCR4 targeting guide RNA
gcaagagaaaacauccacuuu

SEQ ID NO: 2882 - RNA, 21 nt, Artificial Sequence
  CXCR4 targeting guide RNA
gcuuugcaagagaaaacaucc

SEQ ID NO: 2883 - RNA, 21 nt, Artificial Sequence
  CXCR4 targeting guide RNA
ggaaaacaaaggcuuugcaag

SEQ ID NO: 2884 - RNA, 21 nt, Artificial Sequence
  CXCR4 targeting guide RNA
ggaaaguggauguuuucucuu

SEQ ID NO: 2885 - RNA, 21 nt, Artificial Sequence
  CXCR4 targeting guide RNA
ggauguuuucucuugcaaagc

SEQ ID NO: 2886 - RNA, 21 nt, Artificial Sequence
  CXCR4 targeting guide RNA
ggcuuugcaagagaaaacauc

SEQ ID NO: 2887 - RNA, 21 nt, Artificial Sequence
  CXCR4 targeting guide RNA
gggaaaguggauguuuucucu

SEQ ID NO: 2888 - RNA, 21 nt, Artificial Sequence
  CXCR4 targeting guide RNA
ggggaaaguggauguuuucuc

SEQ ID NO: 2889 - RNA, 21 nt, Artificial Sequence
  CXCR4 targeting guide RNA
gggggaaaguggauguuuucu

SEQ ID NO: 2890 - RNA, 21 nt, Artificial Sequence
  CXCR4 targeting guide RNA
ggggggaaaguggauguuuuc

SEQ ID NO: 2891 - RNA, 21 nt, Artificial Sequence
  CXCR4 targeting guide RNA
guggauguuuucucuugcaaa

SEQ ID NO: 2892 - RNA, 21 nt, Artificial Sequence
  CXCR4 targeting guide RNA
guuuucucuugcaaagccuuu

SEQ ID NO: 2893 - RNA, 21 nt, Artificial Sequence
  CXCR4 targeting guide RNA
uaggggggaaaguggauguuu

SEQ ID NO: 2894 - RNA, 21 nt, Artificial Sequence
  CXCR4 targeting guide RNA
ucucuugcaaagccuuuguuu

SEQ ID NO: 2895 - RNA, 21 nt, Artificial Sequence
  CXCR4 targeting guide RNA
ugcaagagaaaacauccacuu

SEQ ID NO: 2896 - RNA, 21 nt, Artificial Sequence
  CXCR4 targeting guide RNA
uggauguuuucucuugcaaag

SEQ ID NO: 2897 - RNA, 21 nt, Artificial Sequence
  CXCR4 targeting guide RNA
uguuuucucuugcaaagccuu

SEQ ID NO: 2898 - RNA, 21 nt, Artificial Sequence
  CXCR4 targeting guide RNA
uucucuugcaaagccuuuguu

SEQ ID NO: 2899 - RNA, 21 nt, Artificial Sequence
  CXCR4 targeting guide RNA
uugcaagagaaaacauccacu

SEQ ID NO: 2900 - RNA, 21 nt, Artificial Sequence
  CXCR4 targeting guide RNA
uuucucuugcaaagccuuugu

SEQ ID NO: 2901 - RNA, 21 nt, Artificial Sequence
  CXCR4 targeting guide RNA
uuugcaagagaaaacauccac

SEQ ID NO: 2902 - RNA, 21 nt, Artificial Sequence
  CXCR4 targeting guide RNA
uuuucucuugcaaagccuuug

SEQ ID NO: 2903 - RNA, 22 nt, Artificial Sequence
  CXCR4 targeting guide RNA
aaaacaaaggcuuugcaagaga

SEQ ID NO: 2904 - RNA, 22 nt, Artificial Sequence
  CXCR4 targeting guide RNA
aaacaaaggcuuugcaagagaa

SEQ ID NO: 2905 - RNA, 22 nt, Artificial Sequence
  CXCR4 targeting guide RNA
aaaggcuuugcaagagaaaaca

SEQ ID NO: 2906 - RNA, 22 nt, Artificial Sequence
  CXCR4 targeting guide RNA
aaaguggauguuuucucuugca

SEQ ID NO: 2907 - RNA, 22 nt, Artificial Sequence
  CXCR4 targeting guide RNA
aacaaaggcuuugcaagagaaa

SEQ ID NO: 2908 - RNA, 22 nt, Artificial Sequence
  CXCR4 targeting guide RNA
aacuaggggggaaaguggaugu

SEQ ID NO: 2909 - RNA, 22 nt, Artificial Sequence
  CXCR4 targeting guide RNA
aagagaaaacauccacuuuccc

SEQ ID NO: 2910 - RNA, 22 nt, Artificial Sequence
  CXCR4 targeting guide RNA
aaggcuuugcaagagaaaacau

SEQ ID NO: 2911 - RNA, 22 nt, Artificial Sequence
  CXCR4 targeting guide RNA
aaguggauguuuucucuugcaa

SEQ ID NO: 2912 - RNA, 22 nt, Artificial Sequence
  CXCR4 targeting guide RNA
acaaaggcuuugcaagagaaaa

SEQ ID NO: 2913 - RNA, 22 nt, Artificial Sequence
  CXCR4 targeting guide RNA
acuaggggggaaaguggauguu

SEQ ID NO: 2914 - RNA, 22 nt, Artificial Sequence
  CXCR4 targeting guide RNA
agaaaacauccacuuucccccc

SEQ ID NO: 2915 - RNA, 22 nt, Artificial Sequence
  CXCR4 targeting guide RNA
agagaaaacauccacuuucccc

SEQ ID NO: 2916 - RNA, 22 nt, Artificial Sequence
  CXCR4 targeting guide RNA
aggaaaacaaaggcuuugcaag

SEQ ID NO: 2917 - RNA, 22 nt, Artificial Sequence
  CXCR4 targeting guide RNA
aggcuuugcaagagaaaacauc

SEQ ID NO: 2918 - RNA, 22 nt, Artificial Sequence
  CXCR4 targeting guide RNA
aggggggaaaguggauguuuuc

SEQ ID NO: 2919 - RNA, 22 nt, Artificial Sequence
  CXCR4 targeting guide RNA
aguggauguuuucucuugcaaa

SEQ ID NO: 2920 - RNA, 22 nt, Artificial Sequence
  CXCR4 targeting guide RNA
auguuuucucuugcaaagccuu

SEQ ID NO: 2921 - RNA, 22 nt, Artificial Sequence
  CXCR4 targeting guide RNA
caaaggcuuugcaagagaaaac

SEQ ID NO: 2922 - RNA, 22 nt, Artificial Sequence
  CXCR4 targeting guide RNA
caagagaaaacauccacuuucc

SEQ ID NO: 2923 - RNA, 22 nt, Artificial Sequence
  CXCR4 targeting guide RNA
cuaggggggaaaguggauguuu

SEQ ID NO: 2924 - RNA, 22 nt, Artificial Sequence
  CXCR4 targeting guide RNA
cuuugcaagagaaaacauccac

SEQ ID NO: 2925 - RNA, 22 nt, Artificial Sequence
  CXCR4 targeting guide RNA
gaaaacaaaggcuuugcaagag

SEQ ID NO: 2926 - RNA, 22 nt, Artificial Sequence
  CXCR4 targeting guide RNA
gaaaacauccacuuuccccccu

SEQ ID NO: 2927 - RNA, 22 nt, Artificial Sequence
  CXCR4 targeting guide RNA
gaaaguggauguuuucucuugc

SEQ ID NO: 2928 - RNA, 22 nt, Artificial Sequence
  CXCR4 targeting guide RNA
gagaaaacauccacuuuccccc

SEQ ID NO: 2929 - RNA, 22 nt, Artificial Sequence
  CXCR4 targeting guide RNA
gauguuuucucuugcaaagccu

SEQ ID NO: 2930 - RNA, 22 nt, Artificial Sequence
  CXCR4 targeting guide RNA
gcaagagaaaacauccacuuuc

SEQ ID NO: 2931 - RNA, 22 nt, Artificial Sequence
  CXCR4 targeting guide RNA
gcuuugcaagagaaaacaucca

SEQ ID NO: 2932 - RNA, 22 nt, Artificial Sequence
  CXCR4 targeting guide RNA
ggaaaacaaaggcuuugcaaga

SEQ ID NO: 2933 - RNA, 22 nt, Artificial Sequence
  CXCR4 targeting guide RNA
ggaaaguggauguuuucucuug

SEQ ID NO: 2934 - RNA, 22 nt, Artificial Sequence
  CXCR4 targeting guide RNA
ggauguuuucucuugcaaagcc

SEQ ID NO: 2935 - RNA, 22 nt, Artificial Sequence
  CXCR4 targeting guide RNA
ggcuuugcaagagaaaacaucc

SEQ ID NO: 2936 - RNA, 22 nt, Artificial Sequence
  CXCR4 targeting guide RNA
gggaaaguggauguuuucucuu

SEQ ID NO: 2937 - RNA, 22 nt, Artificial Sequence
  CXCR4 targeting guide RNA
ggggaaaguggauguuuucucu

SEQ ID NO: 2938 - RNA, 22 nt, Artificial Sequence
  CXCR4 targeting guide RNA
gggggaaaguggauguuuucuc

SEQ ID NO: 2939 - RNA, 22 nt, Artificial Sequence
  CXCR4 targeting guide RNA
ggggggaaaguggauguuuucu

SEQ ID NO: 2940 - RNA, 22 nt, Artificial Sequence
  CXCR4 targeting guide RNA
guggauguuuucucuugcaaag

SEQ ID NO: 2941 - RNA, 22 nt, Artificial Sequence
  CXCR4 targeting guide RNA
guuuucucuugcaaagccuuug

SEQ ID NO: 2942 - RNA, 22 nt, Artificial Sequence
  CXCR4 targeting guide RNA
uaggaaaacaaaggcuuugcaa

SEQ ID NO: 2943 - RNA, 22 nt, Artificial Sequence
  CXCR4 targeting guide RNA
uaggggggaaaguggauguuuu

SEQ ID NO: 2944 - RNA, 22 nt, Artificial Sequence
  CXCR4 targeting guide RNA
ucucuugcaaagccuuuguuuu

SEQ ID NO: 2945 - RNA, 22 nt, Artificial Sequence
  CXCR4 targeting guide RNA
ugcaagagaaaacauccacuuu

SEQ ID NO: 2946 - RNA, 22 nt, Artificial Sequence
  CXCR4 targeting guide RNA
uggauguuuucucuugcaaagc

SEQ ID NO: 2947 - RNA, 22 nt, Artificial Sequence
  CXCR4 targeting guide RNA
uguuuucucuugcaaagccuuu

SEQ ID NO: 2948 - RNA, 22 nt, Artificial Sequence
  CXCR4 targeting guide RNA
uucucuugcaaagccuuuguuu

SEQ ID NO: 2949 - RNA, 22 nt, Artificial Sequence
  CXCR4 targeting guide RNA
uugcaagagaaaacauccacuu

SEQ ID NO: 2950 - RNA, 22 nt, Artificial Sequence
  CXCR4 targeting guide RNA
uuucucuugcaaagccuuuguu

SEQ ID NO: 2951 - RNA, 22 nt, Artificial Sequence
  CXCR4 targeting guide RNA
uuugcaagagaaaacauccacu

SEQ ID NO: 2952 - RNA, 22 nt, Artificial Sequence
  CXCR4 targeting guide RNA
uuuucucuugcaaagccuuugu

SEQ ID NO: 2953 - RNA, 20 nt, Artificial Sequence
  CXCR4 targeting guide RNA
aaaaaacauccacuuucccc

SEQ ID NO: 2954 - RNA, 20 nt, Artificial Sequence
  CXCR4 targeting guide RNA
aaaaacauccacuuuccccc

SEQ ID NO: 2955 - RNA, 20 nt, Artificial Sequence
  CXCR4 targeting guide RNA
aaacaaaggcuuugcaagaa

SEQ ID NO: 2956 - RNA, 20 nt, Artificial Sequence
  CXCR4 targeting guide RNA
aaaggcuuugcaagaaaaaa

SEQ ID NO: 2957 - RNA, 20 nt, Artificial Sequence
  CXCR4 targeting guide RNA
aaaguggauguuuuuucuug

SEQ ID NO: 2958 - RNA, 20 nt, Artificial Sequence
  CXCR4 targeting guide RNA
aacaaaggcuuugcaagaaa

SEQ ID NO: 2959 - RNA, 20 nt, Artificial Sequence
  CXCR4 targeting guide RNA
aagaaaaaacauccacuuuc

SEQ ID NO: 2960 - RNA, 20 nt, Artificial Sequence
  CXCR4 targeting guide RNA
aaggcuuugcaagaaaaaac

SEQ ID NO: 2961 - RNA, 20 nt, Artificial Sequence
  CXCR4 targeting guide RNA
aaguggauguuuuuucuugc

SEQ ID NO: 2962 - RNA, 20 nt, Artificial Sequence
  CXCR4 targeting guide RNA
acaaaggcuuugcaagaaaa

SEQ ID NO: 2963 - RNA, 20 nt, Artificial Sequence
  CXCR4 targeting guide RNA
agaaaaaacauccacuuucc

SEQ ID NO: 2964 - RNA, 20 nt, Artificial Sequence
  CXCR4 targeting guide RNA
aggcuuugcaagaaaaaaca

SEQ ID NO: 2965 - RNA, 20 nt, Artificial Sequence
  CXCR4 targeting guide RNA
aguggauguuuuuucuugca

SEQ ID NO: 2966 - RNA, 20 nt, Artificial Sequence
  CXCR4 targeting guide RNA
auguuuuuucuugcaaagcc

SEQ ID NO: 2967 - RNA, 20 nt, Artificial Sequence
  CXCR4 targeting guide RNA
caaaggcuuugcaagaaaaa

SEQ ID NO: 2968 - RNA, 20 nt, Artificial Sequence
  CXCR4 targeting guide RNA
caagaaaaaacauccacuuu

SEQ ID NO: 2969 - RNA, 20 nt, Artificial Sequence
  CXCR4 targeting guide RNA
cuuugcaagaaaaaacaucc

SEQ ID NO: 2970 - RNA, 20 nt, Artificial Sequence
  CXCR4 targeting guide RNA
gaaaaaacauccacuuuccc

SEQ ID NO: 2971 - RNA, 20 nt, Artificial Sequence
  CXCR4 targeting guide RNA
gaaaguggauguuuuuucuu

SEQ ID NO: 2972 - RNA, 20 nt, Artificial Sequence
  CXCR4 targeting guide RNA
gauguuuuuucuugcaaagc

SEQ ID NO: 2973 - RNA, 20 nt, Artificial Sequence
  CXCR4 targeting guide RNA
gcaagaaaaaacauccacuu

SEQ ID NO: 2974 - RNA, 20 nt, Artificial Sequence
  CXCR4 targeting guide RNA
gcuuugcaagaaaaaacauc

SEQ ID NO: 2975 - RNA, 20 nt, Artificial Sequence
  CXCR4 targeting guide RNA
ggaaaguggauguuuuuucu

SEQ ID NO: 2976 - RNA, 20 nt, Artificial Sequence
  CXCR4 targeting guide RNA
ggauguuuuuucuugcaaag

SEQ ID NO: 2977 - RNA, 20 nt, Artificial Sequence
  CXCR4 targeting guide RNA
ggcuuugcaagaaaaaacau

SEQ ID NO: 2978 - RNA, 20 nt, Artificial Sequence
  CXCR4 targeting guide RNA
gggaaaguggauguuuuuuc

SEQ ID NO: 2979 - RNA, 20 nt, Artificial Sequence
  CXCR4 targeting guide RNA
ggggaaaguggauguuuuuu

SEQ ID NO: 2980 - RNA, 20 nt, Artificial Sequence
  CXCR4 targeting guide RNA
gggggaaaguggauguuuuu

SEQ ID NO: 2981 - RNA, 20 nt, Artificial Sequence
  CXCR4 targeting guide RNA
guggauguuuuuucuugcaa

SEQ ID NO: 2982 - RNA, 20 nt, Artificial Sequence
  CXCR4 targeting guide RNA
guuuuuucuugcaaagccuu

SEQ ID NO: 2983 - RNA, 20 nt, Artificial Sequence
  CXCR4 targeting guide RNA
ugcaagaaaaaacauccacu

SEQ ID NO: 2984 - RNA, 20 nt, Artificial Sequence
  CXCR4 targeting guide RNA
uggauguuuuuucuugcaaa

SEQ ID NO: 2985 - RNA, 20 nt, Artificial Sequence
  CXCR4 targeting guide RNA
uguuuuuucuugcaaagccu

SEQ ID NO: 2986 - RNA, 20 nt, Artificial Sequence
  CXCR4 targeting guide RNA
uugcaagaaaaaacauccac

SEQ ID NO: 2987 - RNA, 20 nt, Artificial Sequence
  CXCR4 targeting guide RNA
uuucuugcaaagccuuuguu

SEQ ID NO: 2988 - RNA, 20 nt, Artificial Sequence
  CXCR4 targeting guide RNA
uuugcaagaaaaaacaucca

SEQ ID NO: 2989 - RNA, 20 nt, Artificial Sequence
  CXCR4 targeting guide RNA
uuuucuugcaaagccuuugu

SEQ ID NO: 2990 - RNA, 20 nt, Artificial Sequence
  CXCR4 targeting guide RNA
uuuuucuugcaaagccuuug

SEQ ID NO: 2991 - RNA, 20 nt, Artificial Sequence
  CXCR4 targeting guide RNA
uuuuuucuugcaaagccuuu

SEQ ID NO: 2992 - RNA, 21 nt, Artificial Sequence
  CXCR4 targeting guide RNA
aaaaaacauccacuuuccccc

SEQ ID NO: 2993 - RNA, 21 nt, Artificial Sequence
  CXCR4 targeting guide RNA
aaaaacauccacuuucccccc

SEQ ID NO: 2994 - RNA, 21 nt, Artificial Sequence
  CXCR4 targeting guide RNA
aaaacaaaggcuuugcaagaa

SEQ ID NO: 2995 - RNA, 21 nt, Artificial Sequence
  CXCR4 targeting guide RNA
aaacaaaggcuuugcaagaaa

SEQ ID NO: 2996 - RNA, 21 nt, Artificial Sequence
  CXCR4 targeting guide RNA
aaaggcuuugcaagaaaaaac

SEQ ID NO: 2997 - RNA, 21 nt, Artificial Sequence
  CXCR4 targeting guide RNA
aaaguggauguuuuuucuugc

SEQ ID NO: 2998 - RNA, 21 nt, Artificial Sequence
  CXCR4 targeting guide RNA
aacaaaggcuuugcaagaaaa

SEQ ID NO: 2999 - RNA, 21 nt, Artificial Sequence
  CXCR4 targeting guide RNA
aagaaaaaacauccacuuucc

SEQ ID NO: 3000 - RNA, 21 nt, Artificial Sequence
  CXCR4 targeting guide RNA
aaggcuuugcaagaaaaaaca

SEQ ID NO: 3001 - RNA, 21 nt, Artificial Sequence
  CXCR4 targeting guide RNA
aaguggauguuuuuucuugca

SEQ ID NO: 3002 - RNA, 21 nt, Artificial Sequence
  CXCR4 targeting guide RNA
acaaaggcuuugcaagaaaaa

SEQ ID NO: 3003 - RNA, 21 nt, Artificial Sequence
  CXCR4 targeting guide RNA
agaaaaaacauccacuuuccc

SEQ ID NO: 3004 - RNA, 21 nt, Artificial Sequence
  CXCR4 targeting guide RNA
aggcuuugcaagaaaaaacau

SEQ ID NO: 3005 - RNA, 21 nt, Artificial Sequence
  CXCR4 targeting guide RNA
aguggauguuuuuucuugcaa

SEQ ID NO: 3006 - RNA, 21 nt, Artificial Sequence
  CXCR4 targeting guide RNA
auguuuuuucuugcaaagccu

SEQ ID NO: 3007 - RNA, 21 nt, Artificial Sequence
  CXCR4 targeting guide RNA
caaaggcuuugcaagaaaaaa

SEQ ID NO: 3008 - RNA, 21 nt, Artificial Sequence
  CXCR4 targeting guide RNA
caagaaaaaacauccacuuuc

SEQ ID NO: 3009 - RNA, 21 nt, Artificial Sequence
  CXCR4 targeting guide RNA
cuuugcaagaaaaaacaucca

SEQ ID NO: 3010 - RNA, 21 nt, Artificial Sequence
  CXCR4 targeting guide RNA
gaaaaaacauccacuuucccc

SEQ ID NO: 3011 - RNA, 21 nt, Artificial Sequence
  CXCR4 targeting guide RNA
gaaaguggauguuuuuucuug

SEQ ID NO: 3012 - RNA, 21 nt, Artificial Sequence
  CXCR4 targeting guide RNA
gauguuuuuucuugcaaagcc

SEQ ID NO: 3013 - RNA, 21 nt, Artificial Sequence
  CXCR4 targeting guide RNA
gcaagaaaaaacauccacuuu

SEQ ID NO: 3014 - RNA, 21 nt, Artificial Sequence
  CXCR4 targeting guide RNA
gcuuugcaagaaaaaacaucc

SEQ ID NO: 3015 - RNA, 21 nt, Artificial Sequence
  CXCR4 targeting guide RNA
ggaaaguggauguuuuuucuu

SEQ ID NO: 3016 - RNA, 21 nt, Artificial Sequence
  CXCR4 targeting guide RNA
ggauguuuuuucuugcaaagc

SEQ ID NO: 3017 - RNA, 21 nt, Artificial Sequence
  CXCR4 targeting guide RNA
ggcuuugcaagaaaaaacauc

SEQ ID NO: 3018 - RNA, 21 nt, Artificial Sequence
  CXCR4 targeting guide RNA
gggaaaguggauguuuuuucu

SEQ ID NO: 3019 - RNA, 21 nt, Artificial Sequence
  CXCR4 targeting guide RNA
ggggaaaguggauguuuuuuc

SEQ ID NO: 3020 - RNA, 21 nt, Artificial Sequence
  CXCR4 targeting guide RNA
gggggaaaguggauguuuuuu

SEQ ID NO: 3021 - RNA, 21 nt, Artificial Sequence
  CXCR4 targeting guide RNA
ggggggaaaguggauguuuuu

SEQ ID NO: 3022 - RNA, 21 nt, Artificial Sequence
  CXCR4 targeting guide RNA
guggauguuuuuucuugcaaa

SEQ ID NO: 3023 - RNA, 21 nt, Artificial Sequence
  CXCR4 targeting guide RNA
guuuuuucuugcaaagccuuu

SEQ ID NO: 3024 - RNA, 21 nt, Artificial Sequence
  CXCR4 targeting guide RNA
ugcaagaaaaaacauccacuu

SEQ ID NO: 3025 - RNA, 21 nt, Artificial Sequence
  CXCR4 targeting guide RNA
uggauguuuuuucuugcaaag

SEQ ID NO: 3026 - RNA, 21 nt, Artificial Sequence
  CXCR4 targeting guide RNA
uguuuuuucuugcaaagccuu

SEQ ID NO: 3027 - RNA, 21 nt, Artificial Sequence
  CXCR4 targeting guide RNA
uugcaagaaaaaacauccacu

SEQ ID NO: 3028 - RNA, 21 nt, Artificial Sequence
  CXCR4 targeting guide RNA
uuucuugcaaagccuuuguuu

SEQ ID NO: 3029 - RNA, 21 nt, Artificial Sequence
  CXCR4 targeting guide RNA
uuugcaagaaaaaacauccac

SEQ ID NO: 3030 - RNA, 21 nt, Artificial Sequence
  CXCR4 targeting guide RNA
uuuucuugcaaagccuuuguu

SEQ ID NO: 3031 - RNA, 21 nt, Artificial Sequence
  CXCR4 targeting guide RNA
uuuuucuugcaaagccuuugu

SEQ ID NO: 3032 - RNA, 21 nt, Artificial Sequence
  CXCR4 targeting guide RNA
uuuuuucuugcaaagccuuug

SEQ ID NO: 3033 - RNA, 22 nt, Artificial Sequence
  CXCR4 targeting guide RNA
aaaaaacauccacuuucccccc

SEQ ID NO: 3034 - RNA, 22 nt, Artificial Sequence
  CXCR4 targeting guide RNA
aaaaacauccacuuuccccccu

SEQ ID NO: 3035 - RNA, 22 nt, Artificial Sequence
  CXCR4 targeting guide RNA
aaaacaaaggcuuugcaagaaa

SEQ ID NO: 3036 - RNA, 22 nt, Artificial Sequence
  CXCR4 targeting guide RNA
aaacaaaggcuuugcaagaaaa

SEQ ID NO: 3037 - RNA, 22 nt, Artificial Sequence
  CXCR4 targeting guide RNA
aaaggcuuugcaagaaaaaaca

SEQ ID NO: 3038 - RNA, 22 nt, Artificial Sequence
  CXCR4 targeting guide RNA
aaaguggauguuuuuucuugca

SEQ ID NO: 3039 - RNA, 22 nt, Artificial Sequence
  CXCR4 targeting guide RNA
aacaaaggcuuugcaagaaaaa

SEQ ID NO: 3040 - RNA, 22 nt, Artificial Sequence
  CXCR4 targeting guide RNA
aagaaaaaacauccacuuuccc

SEQ ID NO: 3041 - RNA, 22 nt, Artificial Sequence
  CXCR4 targeting guide RNA
aaggcuuugcaagaaaaaacau

SEQ ID NO: 3042 - RNA, 22 nt, Artificial Sequence
  CXCR4 targeting guide RNA
aaguggauguuuuuucuugcaa

SEQ ID NO: 3043 - RNA, 22 nt, Artificial Sequence
  CXCR4 targeting guide RNA
acaaaggcuuugcaagaaaaaa

SEQ ID NO: 3044 - RNA, 22 nt, Artificial Sequence
  CXCR4 targeting guide RNA
agaaaaaacauccacuuucccc

SEQ ID NO: 3045 - RNA, 22 nt, Artificial Sequence
  CXCR4 targeting guide RNA
aggcuuugcaagaaaaaacauc

SEQ ID NO: 3046 - RNA, 22 nt, Artificial Sequence
  CXCR4 targeting guide RNA
aggggggaaaguggauguuuuu

SEQ ID NO: 3047 - RNA, 22 nt, Artificial Sequence
  CXCR4 targeting guide RNA
aguggauguuuuuucuugcaaa

SEQ ID NO: 3048 - RNA, 22 nt, Artificial Sequence
  CXCR4 targeting guide RNA
auguuuuuucuugcaaagccuu

SEQ ID NO: 3049 - RNA, 22 nt, Artificial Sequence
  CXCR4 targeting guide RNA
caaaggcuuugcaagaaaaaac

SEQ ID NO: 3050 - RNA, 22 nt, Artificial Sequence
  CXCR4 targeting guide RNA
caagaaaaaacauccacuuucc

SEQ ID NO: 3051 - RNA, 22 nt, Artificial Sequence
  CXCR4 targeting guide RNA
cuuugcaagaaaaaacauccac

SEQ ID NO: 3052 - RNA, 22 nt, Artificial Sequence
  CXCR4 targeting guide RNA
gaaaaaacauccacuuuccccc

SEQ ID NO: 3053 - RNA, 22 nt, Artificial Sequence
  CXCR4 targeting guide RNA
gaaaacaaaggcuuugcaagaa

SEQ ID NO: 3054 - RNA, 22 nt, Artificial Sequence
  CXCR4 targeting guide RNA
gaaaguggauguuuuuucuugc

SEQ ID NO: 3055 - RNA, 22 nt, Artificial Sequence
  CXCR4 targeting guide RNA
gauguuuuuucuugcaaagccu

SEQ ID NO: 3056 - RNA, 22 nt, Artificial Sequence
  CXCR4 targeting guide RNA
gcaagaaaaaacauccacuuuc

SEQ ID NO: 3057 - RNA, 22 nt, Artificial Sequence
  CXCR4 targeting guide RNA
gcuuugcaagaaaaaacaucca

SEQ ID NO: 3058 - RNA, 22 nt, Artificial Sequence
  CXCR4 targeting guide RNA
ggaaaguggauguuuuuucuug

SEQ ID NO: 3059 - RNA, 22 nt, Artificial Sequence
  CXCR4 targeting guide RNA
ggauguuuuuucuugcaaagcc

SEQ ID NO: 3060 - RNA, 22 nt, Artificial Sequence
  CXCR4 targeting guide RNA
ggcuuugcaagaaaaaacaucc

SEQ ID NO: 3061 - RNA, 22 nt, Artificial Sequence
  CXCR4 targeting guide RNA
gggaaaguggauguuuuuucuu

SEQ ID NO: 3062 - RNA, 22 nt, Artificial Sequence
  CXCR4 targeting guide RNA
ggggaaaguggauguuuuuucu

SEQ ID NO: 3063 - RNA, 22 nt, Artificial Sequence
  CXCR4 targeting guide RNA
gggggaaaguggauguuuuuuc

SEQ ID NO: 3064 - RNA, 22 nt, Artificial Sequence
  CXCR4 targeting guide RNA
ggggggaaaguggauguuuuuu

SEQ ID NO: 3065 - RNA, 22 nt, Artificial Sequence
  CXCR4 targeting guide RNA
guggauguuuuuucuugcaaag

SEQ ID NO: 3066 - RNA, 22 nt, Artificial Sequence
  CXCR4 targeting guide RNA
guuuuuucuugcaaagccuuug

SEQ ID NO: 3067 - RNA, 22 nt, Artificial Sequence
  CXCR4 targeting guide RNA
ugcaagaaaaaacauccacuuu

SEQ ID NO: 3068 - RNA, 22 nt, Artificial Sequence
  CXCR4 targeting guide RNA
uggauguuuuuucuugcaaagc

SEQ ID NO: 3069 - RNA, 22 nt, Artificial Sequence
  CXCR4 targeting guide RNA
uguuuuuucuugcaaagccuuu

SEQ ID NO: 3070 - RNA, 22 nt, Artificial Sequence
  CXCR4 targeting guide RNA
uugcaagaaaaaacauccacuu

SEQ ID NO: 3071 - RNA, 22 nt, Artificial Sequence
  CXCR4 targeting guide RNA
uuucuugcaaagccuuuguuuu

SEQ ID NO: 3072 - RNA, 22 nt, Artificial Sequence
  CXCR4 targeting guide RNA
uuugcaagaaaaaacauccacu

SEQ ID NO: 3073 - RNA, 22 nt, Artificial Sequence
  CXCR4 targeting guide RNA
uuuucuugcaaagccuuuguuu

SEQ ID NO: 3074 - RNA, 22 nt, Artificial Sequence
  CXCR4 targeting guide RNA
uuuuucuugcaaagccuuuguu

SEQ ID NO: 3075 - RNA, 22 nt, Artificial Sequence
  CXCR4 targeting guide RNA
uuuuuucuugcaaagccuuugu

SEQ ID NO: 3076 - RNA, 20 nt, Artificial Sequence
  CXCR4 targeting guide RNA
agcauuaacccaguuaaaaa

SEQ ID NO: 3077 - RNA, 20 nt, Artificial Sequence
  CXCR4 targeting guide RNA
gcauuaacccaguuaaaaaa

SEQ ID NO: 3078 - RNA, 22 nt, Artificial Sequence
  CXCR4 targeting guide RNA
caagcauuaacccaguuaaaaa

SEQ ID NO: 3079 - RNA, 20 nt, Artificial Sequence
  CXCR4 targeting guide RNA
aaagacucauucuccuaaag

SEQ ID NO: 3080 - RNA, 20 nt, Artificial Sequence
  CXCR4 targeting guide RNA
aagacucauucuccuaaagc

SEQ ID NO: 3081 - RNA, 20 nt, Artificial Sequence
  CXCR4 targeting guide RNA
aaguuuuugcgcuuuaggag

SEQ ID NO: 3082 - RNA, 20 nt, Artificial Sequence
  CXCR4 targeting guide RNA
acucauucuccuaaagcgca

SEQ ID NO: 3083 - RNA, 20 nt, Artificial Sequence
  CXCR4 targeting guide RNA
agacucauucuccuaaagcg

SEQ ID NO: 3084 - RNA, 20 nt, Artificial Sequence
  CXCR4 targeting guide RNA
agcgcaaaaacuuaauuuuc

SEQ ID NO: 3085 - RNA, 20 nt, Artificial Sequence
  CXCR4 targeting guide RNA
aguuuuugcgcuuuaggaga

SEQ ID NO: 3086 - RNA, 20 nt, Artificial Sequence
  CXCR4 targeting guide RNA
auuaaguuuuugcgcuuuag

SEQ ID NO: 3087 - RNA, 20 nt, Artificial Sequence
  CXCR4 targeting guide RNA
auucuccuaaagcgcaaaaa

SEQ ID NO: 3088 - RNA, 20 nt, Artificial Sequence
  CXCR4 targeting guide RNA
caaagacucauucuccuaaa

SEQ ID NO: 3089 - RNA, 20 nt, Artificial Sequence
  CXCR4 targeting guide RNA
cauucuccuaaagcgcaaaa

SEQ ID NO: 3090 - RNA, 20 nt, Artificial Sequence
  CXCR4 targeting guide RNA
ccuaaagcgcaaaaacuuaa

SEQ ID NO: 3091 - RNA, 20 nt, Artificial Sequence
  CXCR4 targeting guide RNA
cgcuuuaggagaaugagucu

SEQ ID NO: 3092 - RNA, 20 nt, Artificial Sequence
  CXCR4 targeting guide RNA
cuaaagcgcaaaaacuuaau

SEQ ID NO: 3093 - RNA, 20 nt, Artificial Sequence
  CXCR4 targeting guide RNA
cucauucuccuaaagcgcaa

SEQ ID NO: 3094 - RNA, 20 nt, Artificial Sequence
  CXCR4 targeting guide RNA
cuccuaaagcgcaaaaacuu

SEQ ID NO: 3095 - RNA, 20 nt, Artificial Sequence
  CXCR4 targeting guide RNA
cuuuaggagaaugagucuuu

SEQ ID NO: 3096 - RNA, 20 nt, Artificial Sequence
  CXCR4 targeting guide RNA
gaaaauuaaguuuuugcgcu

SEQ ID NO: 3097 - RNA, 20 nt, Artificial Sequence
  CXCR4 targeting guide RNA
gacucauucuccuaaagcgc

SEQ ID NO: 3098 - RNA, 20 nt, Artificial Sequence
  CXCR4 targeting guide RNA
gcaaagacucauucuccuaa

SEQ ID NO: 3099 - RNA, 20 nt, Artificial Sequence
  CXCR4 targeting guide RNA
gcgcuuuaggagaaugaguc

SEQ ID NO: 3100 - RNA, 20 nt, Artificial Sequence
  CXCR4 targeting guide RNA
gcuuuaggagaaugagucuu

SEQ ID NO: 3101 - RNA, 20 nt, Artificial Sequence
  CXCR4 targeting guide RNA
ggaaaauuaaguuuuugcgc

SEQ ID NO: 3102 - RNA, 20 nt, Artificial Sequence
  CXCR4 targeting guide RNA
gggaaaauuaaguuuuugcg

SEQ ID NO: 3103 - RNA, 20 nt, Artificial Sequence
  CXCR4 targeting guide RNA
gugggaaaauuaaguuuuug

SEQ ID NO: 3104 - RNA, 20 nt, Artificial Sequence
  CXCR4 targeting guide RNA
guuuuugcgcuuuaggagaa

SEQ ID NO: 3105 - RNA, 20 nt, Artificial Sequence
  CXCR4 targeting guide RNA
uaaguuuuugcgcuuuagga

SEQ ID NO: 3106 - RNA, 20 nt, Artificial Sequence
  CXCR4 targeting guide RNA
ucauucuccuaaagcgcaaa

SEQ ID NO: 3107 - RNA, 20 nt, Artificial Sequence
  CXCR4 targeting guide RNA
uccuaaagcgcaaaaacuua

SEQ ID NO: 3108 - RNA, 20 nt, Artificial Sequence
  CXCR4 targeting guide RNA
ucuccuaaagcgcaaaaacu

SEQ ID NO: 3109 - RNA, 20 nt, Artificial Sequence
  CXCR4 targeting guide RNA
ugcaaagacucauucuccua

SEQ ID NO: 3110 - RNA, 20 nt, Artificial Sequence
  CXCR4 targeting guide RNA
ugcgcuuuaggagaaugagu

SEQ ID NO: 3111 - RNA, 20 nt, Artificial Sequence
  CXCR4 targeting guide RNA
ugggaaaauuaaguuuuugc

SEQ ID NO: 3112 - RNA, 20 nt, Artificial Sequence
  CXCR4 targeting guide RNA
uuaaguuuuugcgcuuuagg

SEQ ID NO: 3113 - RNA, 20 nt, Artificial Sequence
  CXCR4 targeting guide RNA
uucuccuaaagcgcaaaaac

SEQ ID NO: 3114 - RNA, 20 nt, Artificial Sequence
  CXCR4 targeting guide RNA
uugcaaagacucauucuccu

SEQ ID NO: 3115 - RNA, 20 nt, Artificial Sequence
  CXCR4 targeting guide RNA
uugcgcuuuaggagaaugag

SEQ ID NO: 3116 - RNA, 20 nt, Artificial Sequence
  CXCR4 targeting guide RNA
uuugcgcuuuaggagaauga

SEQ ID NO: 3117 - RNA, 20 nt, Artificial Sequence
  CXCR4 targeting guide RNA
uuuugcgcuuuaggagaaug

SEQ ID NO: 3118 - RNA, 20 nt, Artificial Sequence
  CXCR4 targeting guide RNA
uuuuugcgcuuuaggagaau

SEQ ID NO: 3119 - RNA, 21 nt, Artificial Sequence
  CXCR4 targeting guide RNA
aaagacucauucuccuaaagc

SEQ ID NO: 3120 - RNA, 21 nt, Artificial Sequence
  CXCR4 targeting guide RNA
aagacucauucuccuaaagcg

SEQ ID NO: 3121 - RNA, 21 nt, Artificial Sequence
  CXCR4 targeting guide RNA
aaguuuuugcgcuuuaggaga

SEQ ID NO: 3122 - RNA, 21 nt, Artificial Sequence
  CXCR4 targeting guide RNA
acucauucuccuaaagcgcaa

SEQ ID NO: 3123 - RNA, 21 nt, Artificial Sequence
  CXCR4 targeting guide RNA
agacucauucuccuaaagcgc

SEQ ID NO: 3124 - RNA, 21 nt, Artificial Sequence
  CXCR4 targeting guide RNA
agcgcaaaaacuuaauuuucc

SEQ ID NO: 3125 - RNA, 21 nt, Artificial Sequence
  CXCR4 targeting guide RNA
aguuuuugcgcuuuaggagaa

SEQ ID NO: 3126 - RNA, 21 nt, Artificial Sequence
  CXCR4 targeting guide RNA
auuaaguuuuugcgcuuuagg

SEQ ID NO: 3127 - RNA, 21 nt, Artificial Sequence
  CXCR4 targeting guide RNA
auucuccuaaagcgcaaaaac

SEQ ID NO: 3128 - RNA, 21 nt, Artificial Sequence
  CXCR4 targeting guide RNA
caaagacucauucuccuaaag

SEQ ID NO: 3129 - RNA, 21 nt, Artificial Sequence
  CXCR4 targeting guide RNA
cauucuccuaaagcgcaaaaa

SEQ ID NO: 3130 - RNA, 21 nt, Artificial Sequence
  CXCR4 targeting guide RNA
ccuaaagcgcaaaaacuuaau

SEQ ID NO: 3131 - RNA, 21 nt, Artificial Sequence
  CXCR4 targeting guide RNA
cgcuuuaggagaaugagucuu

SEQ ID NO: 3132 - RNA, 21 nt, Artificial Sequence
  CXCR4 targeting guide RNA
cgugggaaaauuaaguuuuug

SEQ ID NO: 3133 - RNA, 21 nt, Artificial Sequence
  CXCR4 targeting guide RNA
cucauucuccuaaagcgcaaa

SEQ ID NO: 3134 - RNA, 21 nt, Artificial Sequence
  CXCR4 targeting guide RNA
cuccuaaagcgcaaaaacuua

SEQ ID NO: 3135 - RNA, 21 nt, Artificial Sequence
  CXCR4 targeting guide RNA
cuuuaggagaaugagucuuug

SEQ ID NO: 3136 - RNA, 21 nt, Artificial Sequence
  CXCR4 targeting guide RNA
gacucauucuccuaaagcgca

SEQ ID NO: 3137 - RNA, 21 nt, Artificial Sequence
  CXCR4 targeting guide RNA
gcaaagacucauucuccuaaa

SEQ ID NO: 3138 - RNA, 21 nt, Artificial Sequence
  CXCR4 targeting guide RNA
gcgcuuuaggagaaugagucu

SEQ ID NO: 3139 - RNA, 21 nt, Artificial Sequence
  CXCR4 targeting guide RNA
gcuuuaggagaaugagucuuu

SEQ ID NO: 3140 - RNA, 21 nt, Artificial Sequence
  CXCR4 targeting guide RNA
ggaaaauuaaguuuuugcgcu

SEQ ID NO: 3141 - RNA, 21 nt, Artificial Sequence
  CXCR4 targeting guide RNA
gggaaaauuaaguuuuugcgc

SEQ ID NO: 3142 - RNA, 21 nt, Artificial Sequence
  CXCR4 targeting guide RNA
gugggaaaauuaaguuuuugc

SEQ ID NO: 3143 - RNA, 21 nt, Artificial Sequence
  CXCR4 targeting guide RNA
guugcaaagacucauucuccu

SEQ ID NO: 3144 - RNA, 21 nt, Artificial Sequence
  CXCR4 targeting guide RNA
guuuuugcgcuuuaggagaau

SEQ ID NO: 3145 - RNA, 21 nt, Artificial Sequence
  CXCR4 targeting guide RNA
uaaguuuuugcgcuuuaggag

SEQ ID NO: 3146 - RNA, 21 nt, Artificial Sequence
  CXCR4 targeting guide RNA
ucauucuccuaaagcgcaaaa

SEQ ID NO: 3147 - RNA, 21 nt, Artificial Sequence
  CXCR4 targeting guide RNA
uccuaaagcgcaaaaacuuaa

SEQ ID NO: 3148 - RNA, 21 nt, Artificial Sequence
  CXCR4 targeting guide RNA
ucuccuaaagcgcaaaaacuu

SEQ ID NO: 3149 - RNA, 21 nt, Artificial Sequence
  CXCR4 targeting guide RNA
ugcaaagacucauucuccuaa

SEQ ID NO: 3150 - RNA, 21 nt, Artificial Sequence
  CXCR4 targeting guide RNA
ugcgcuuuaggagaaugaguc

SEQ ID NO: 3151 - RNA, 21 nt, Artificial Sequence
  CXCR4 targeting guide RNA
ugggaaaauuaaguuuuugcg

SEQ ID NO: 3152 - RNA, 21 nt, Artificial Sequence
  CXCR4 targeting guide RNA
uuaaguuuuugcgcuuuagga

SEQ ID NO: 3153 - RNA, 21 nt, Artificial Sequence
  CXCR4 targeting guide RNA
uucuccuaaagcgcaaaaacu

SEQ ID NO: 3154 - RNA, 21 nt, Artificial Sequence
  CXCR4 targeting guide RNA
uugcaaagacucauucuccua

SEQ ID NO: 3155 - RNA, 21 nt, Artificial Sequence
  CXCR4 targeting guide RNA
uugcgcuuuaggagaaugagu

SEQ ID NO: 3156 - RNA, 21 nt, Artificial Sequence
  CXCR4 targeting guide RNA
uuugcgcuuuaggagaaugag

SEQ ID NO: 3157 - RNA, 21 nt, Artificial Sequence
  CXCR4 targeting guide RNA
uuuugcgcuuuaggagaauga

SEQ ID NO: 3158 - RNA, 21 nt, Artificial Sequence
  CXCR4 targeting guide RNA
uuuuugcgcuuuaggagaaug

SEQ ID NO: 3159 - RNA, 22 nt, Artificial Sequence
  CXCR4 targeting guide RNA
aaagacucauucuccuaaagcg

SEQ ID NO: 3160 - RNA, 22 nt, Artificial Sequence
  CXCR4 targeting guide RNA
aagacucauucuccuaaagcgc

SEQ ID NO: 3161 - RNA, 22 nt, Artificial Sequence
  CXCR4 targeting guide RNA
aagcgcaaaaacuuaauuuucc

SEQ ID NO: 3162 - RNA, 22 nt, Artificial Sequence
  CXCR4 targeting guide RNA
aaguuuuugcgcuuuaggagaa

SEQ ID NO: 3163 - RNA, 22 nt, Artificial Sequence
  CXCR4 targeting guide RNA
aauuaaguuuuugcgcuuuagg

SEQ ID NO: 3164 - RNA, 22 nt, Artificial Sequence
  CXCR4 targeting guide RNA
acucauucuccuaaagcgcaaa

SEQ ID NO: 3165 - RNA, 22 nt, Artificial Sequence
  CXCR4 targeting guide RNA
agacucauucuccuaaagcgca

SEQ ID NO: 3166 - RNA, 22 nt, Artificial Sequence
  CXCR4 targeting guide RNA
agcgcaaaaacuuaauuuuccc

SEQ ID NO: 3167 - RNA, 22 nt, Artificial Sequence
  CXCR4 targeting guide RNA
aguuuuugcgcuuuaggagaau

SEQ ID NO: 3168 - RNA, 22 nt, Artificial Sequence
  CXCR4 targeting guide RNA
auuaaguuuuugcgcuuuagga

SEQ ID NO: 3169 - RNA, 22 nt, Artificial Sequence
  CXCR4 targeting guide RNA
auucuccuaaagcgcaaaaacu

SEQ ID NO: 3170 - RNA, 22 nt, Artificial Sequence
  CXCR4 targeting guide RNA
caaagacucauucuccuaaagc

SEQ ID NO: 3171 - RNA, 22 nt, Artificial Sequence
  CXCR4 targeting guide RNA
cauucuccuaaagcgcaaaaac

SEQ ID NO: 3172 - RNA, 22 nt, Artificial Sequence
  CXCR4 targeting guide RNA
ccuaaagcgcaaaaacuuaauu

SEQ ID NO: 3173 - RNA, 22 nt, Artificial Sequence
  CXCR4 targeting guide RNA
cgcuuuaggagaaugagucuuu

SEQ ID NO: 3174 - RNA, 22 nt, Artificial Sequence
  CXCR4 targeting guide RNA
cgugggaaaauuaaguuuuugc

SEQ ID NO: 3175 - RNA, 22 nt, Artificial Sequence
  CXCR4 targeting guide RNA
cguugcaaagacucauucuccu

SEQ ID NO: 3176 - RNA, 22 nt, Artificial Sequence
  CXCR4 targeting guide RNA
cucauucuccuaaagcgcaaaa

SEQ ID NO: 3177 - RNA, 22 nt, Artificial Sequence
  CXCR4 targeting guide RNA
cuccuaaagcgcaaaaacuuaa

SEQ ID NO: 3178 - RNA, 22 nt, Artificial Sequence
  CXCR4 targeting guide RNA
cuuuaggagaaugagucuuugc

SEQ ID NO: 3179 - RNA, 22 nt, Artificial Sequence
  CXCR4 targeting guide RNA
gacucauucuccuaaagcgcaa

SEQ ID NO: 3180 - RNA, 22 nt, Artificial Sequence
  CXCR4 targeting guide RNA
gcaaagacucauucuccuaaag

SEQ ID NO: 3181 - RNA, 22 nt, Artificial Sequence
  CXCR4 targeting guide RNA
gcgcuuuaggagaaugagucuu

SEQ ID NO: 3182 - RNA, 22 nt, Artificial Sequence
  CXCR4 targeting guide RNA
gcgugggaaaauuaaguuuuug

SEQ ID NO: 3183 - RNA, 22 nt, Artificial Sequence
  CXCR4 targeting guide RNA
gcuuuaggagaaugagucuuug

SEQ ID NO: 3184 - RNA, 22 nt, Artificial Sequence
  CXCR4 targeting guide RNA
ggaaaauuaaguuuuugcgcuu

SEQ ID NO: 3185 - RNA, 22 nt, Artificial Sequence
  CXCR4 targeting guide RNA
gggaaaauuaaguuuuugcgcu

SEQ ID NO: 3186 - RNA, 22 nt, Artificial Sequence
  CXCR4 targeting guide RNA
gugggaaaauuaaguuuuugcg

SEQ ID NO: 3187 - RNA, 22 nt, Artificial Sequence
  CXCR4 targeting guide RNA
guugcaaagacucauucuccua

SEQ ID NO: 3188 - RNA, 22 nt, Artificial Sequence
  CXCR4 targeting guide RNA
guuuuugcgcuuuaggagaaug

SEQ ID NO: 3189 - RNA, 22 nt, Artificial Sequence
  CXCR4 targeting guide RNA
uaaguuuuugcgcuuuaggaga

SEQ ID NO: 3190 - RNA, 22 nt, Artificial Sequence
  CXCR4 targeting guide RNA
ucauucuccuaaagcgcaaaaa

SEQ ID NO: 3191 - RNA, 22 nt, Artificial Sequence
  CXCR4 targeting guide RNA
uccuaaagcgcaaaaacuuaau

SEQ ID NO: 3192 - RNA, 22 nt, Artificial Sequence
  CXCR4 targeting guide RNA
ucuccuaaagcgcaaaaacuua

SEQ ID NO: 3193 - RNA, 22 nt, Artificial Sequence
  CXCR4 targeting guide RNA
ugcaaagacucauucuccuaaa

SEQ ID NO: 3194 - RNA, 22 nt, Artificial Sequence
  CXCR4 targeting guide RNA
ugcgcuuuaggagaaugagucu

SEQ ID NO: 3195 - RNA, 22 nt, Artificial Sequence
  CXCR4 targeting guide RNA
ugggaaaauuaaguuuuugcgc

SEQ ID NO: 3196 - RNA, 22 nt, Artificial Sequence
  CXCR4 targeting guide RNA
uuaaguuuuugcgcuuuaggag

SEQ ID NO: 3197 - RNA, 22 nt, Artificial Sequence
  CXCR4 targeting guide RNA
uucuccuaaagcgcaaaaacuu

SEQ ID NO: 3198 - RNA, 22 nt, Artificial Sequence
  CXCR4 targeting guide RNA
uugcaaagacucauucuccuaa

SEQ ID NO: 3199 - RNA, 22 nt, Artificial Sequence
  CXCR4 targeting guide RNA
uugcgcuuuaggagaaugaguc

SEQ ID NO: 3200 - RNA, 22 nt, Artificial Sequence
  CXCR4 targeting guide RNA
uuugcgcuuuaggagaaugagu

SEQ ID NO: 3201 - RNA, 22 nt, Artificial Sequence
  CXCR4 targeting guide RNA
uuuugcgcuuuaggagaaugag

SEQ ID NO: 3202 - RNA, 22 nt, Artificial Sequence
  CXCR4 targeting guide RNA
uuuuugcgcuuuaggagaauga

SEQ ID NO: 3203 - RNA, 20 nt, Artificial Sequence
  CXCR4 targeting guide RNA
aaaauuaaguuuuugcgccu

SEQ ID NO: 3204 - RNA, 20 nt, Artificial Sequence
  CXCR4 targeting guide RNA
aaagacucauucuccuaagg

SEQ ID NO: 3205 - RNA, 20 nt, Artificial Sequence
  CXCR4 targeting guide RNA
aaauuaaguuuuugcgccuu

SEQ ID NO: 3206 - RNA, 20 nt, Artificial Sequence
  CXCR4 targeting guide RNA
aagacucauucuccuaaggc

SEQ ID NO: 3207 - RNA, 20 nt, Artificial Sequence
  CXCR4 targeting guide RNA
aaggcgcaaaaacuuaauuu

SEQ ID NO: 3208 - RNA, 20 nt, Artificial Sequence
  CXCR4 targeting guide RNA
aaguuuuugcgccuuaggag

SEQ ID NO: 3209 - RNA, 20 nt, Artificial Sequence
  CXCR4 targeting guide RNA
aauuaaguuuuugcgccuua

SEQ ID NO: 3210 - RNA, 20 nt, Artificial Sequence
  CXCR4 targeting guide RNA
acucauucuccuaaggcgca

SEQ ID NO: 3211 - RNA, 20 nt, Artificial Sequence
  CXCR4 targeting guide RNA
agacucauucuccuaaggcg

SEQ ID NO: 3212 - RNA, 20 nt, Artificial Sequence
  CXCR4 targeting guide RNA
aggcgcaaaaacuuaauuuu

SEQ ID NO: 3213 - RNA, 20 nt, Artificial Sequence
  CXCR4 targeting guide RNA
aguuuuugcgccuuaggaga

SEQ ID NO: 3214 - RNA, 20 nt, Artificial Sequence
  CXCR4 targeting guide RNA
auuaaguuuuugcgccuuag

SEQ ID NO: 3215 - RNA, 20 nt, Artificial Sequence
  CXCR4 targeting guide RNA
auucuccuaaggcgcaaaaa

SEQ ID NO: 3216 - RNA, 20 nt, Artificial Sequence
  CXCR4 targeting guide RNA
caaagacucauucuccuaag

SEQ ID NO: 3217 - RNA, 20 nt, Artificial Sequence
  CXCR4 targeting guide RNA
cauucuccuaaggcgcaaaa

SEQ ID NO: 3218 - RNA, 20 nt, Artificial Sequence
  CXCR4 targeting guide RNA
ccuaaggcgcaaaaacuuaa

SEQ ID NO: 3219 - RNA, 20 nt, Artificial Sequence
  CXCR4 targeting guide RNA
ccuuaggagaaugagucuuu

SEQ ID NO: 3220 - RNA, 20 nt, Artificial Sequence
  CXCR4 targeting guide RNA
cgccuuaggagaaugagucu

SEQ ID NO: 3221 - RNA, 20 nt, Artificial Sequence
  CXCR4 targeting guide RNA
cuaaggcgcaaaaacuuaau

SEQ ID NO: 3222 - RNA, 20 nt, Artificial Sequence
  CXCR4 targeting guide RNA
cucauucuccuaaggcgcaa

SEQ ID NO: 3223 - RNA, 20 nt, Artificial Sequence
  CXCR4 targeting guide RNA
cuccuaaggcgcaaaaacuu

SEQ ID NO: 3224 - RNA, 20 nt, Artificial Sequence
  CXCR4 targeting guide RNA
gaaaauuaaguuuuugcgcc

SEQ ID NO: 3225 - RNA, 20 nt, Artificial Sequence
  CXCR4 targeting guide RNA
gacucauucuccuaaggcgc

SEQ ID NO: 3226 - RNA, 20 nt, Artificial Sequence
  CXCR4 targeting guide RNA
gccuuaggagaaugagucuu

SEQ ID NO: 3227 - RNA, 20 nt, Artificial Sequence
  CXCR4 targeting guide RNA
gcgccuuaggagaaugaguc

SEQ ID NO: 3228 - RNA, 20 nt, Artificial Sequence
  CXCR4 targeting guide RNA
ggcgcaaaaacuuaauuuuc

SEQ ID NO: 3229 - RNA, 20 nt, Artificial Sequence
  CXCR4 targeting guide RNA
guuuuugcgccuuaggagaa

SEQ ID NO: 3230 - RNA, 20 nt, Artificial Sequence
  CXCR4 targeting guide RNA
uaaggcgcaaaaacuuaauu

SEQ ID NO: 3231 - RNA, 20 nt, Artificial Sequence
  CXCR4 targeting guide RNA
uaaguuuuugcgccuuagga

SEQ ID NO: 3232 - RNA, 20 nt, Artificial Sequence
  CXCR4 targeting guide RNA
ucauucuccuaaggcgcaaa

SEQ ID NO: 3233 - RNA, 20 nt, Artificial Sequence
  CXCR4 targeting guide RNA
uccuaaggcgcaaaaacuua

SEQ ID NO: 3234 - RNA, 20 nt, Artificial Sequence
  CXCR4 targeting guide RNA
ucuccuaaggcgcaaaaacu

SEQ ID NO: 3235 - RNA, 20 nt, Artificial Sequence
  CXCR4 targeting guide RNA
ugcgccuuaggagaaugagu

SEQ ID NO: 3236 - RNA, 20 nt, Artificial Sequence
  CXCR4 targeting guide RNA
uuaaguuuuugcgccuuagg

SEQ ID NO: 3237 - RNA, 20 nt, Artificial Sequence
  CXCR4 targeting guide RNA
uucuccuaaggcgcaaaaac

SEQ ID NO: 3238 - RNA, 20 nt, Artificial Sequence
  CXCR4 targeting guide RNA
uugcgccuuaggagaaugag

SEQ ID NO: 3239 - RNA, 20 nt, Artificial Sequence
  CXCR4 targeting guide RNA
uuugcgccuuaggagaauga

SEQ ID NO: 3240 - RNA, 20 nt, Artificial Sequence
  CXCR4 targeting guide RNA
uuuugcgccuuaggagaaug

SEQ ID NO: 3241 - RNA, 20 nt, Artificial Sequence
  CXCR4 targeting guide RNA
uuuuugcgccuuaggagaau

SEQ ID NO: 3242 - RNA, 21 nt, Artificial Sequence
  CXCR4 targeting guide RNA
aaagacucauucuccuaaggc

SEQ ID NO: 3243 - RNA, 21 nt, Artificial Sequence
  CXCR4 targeting guide RNA
aagacucauucuccuaaggcg

SEQ ID NO: 3244 - RNA, 21 nt, Artificial Sequence
  CXCR4 targeting guide RNA
aaguuuuugcgccuuaggaga

SEQ ID NO: 3245 - RNA, 21 nt, Artificial Sequence
  CXCR4 targeting guide RNA
aauuaaguuuuugcgccuuag

SEQ ID NO: 3246 - RNA, 21 nt, Artificial Sequence
  CXCR4 targeting guide RNA
acucauucuccuaaggcgcaa

SEQ ID NO: 3247 - RNA, 21 nt, Artificial Sequence
  CXCR4 targeting guide RNA
agacucauucuccuaaggcgc

SEQ ID NO: 3248 - RNA, 21 nt, Artificial Sequence
  CXCR4 targeting guide RNA
aggcgcaaaaacuuaauuuuc

SEQ ID NO: 3249 - RNA, 21 nt, Artificial Sequence
  CXCR4 targeting guide RNA
aguuuuugcgccuuaggagaa

SEQ ID NO: 3250 - RNA, 21 nt, Artificial Sequence
  CXCR4 targeting guide RNA
auuaaguuuuugcgccuuagg

SEQ ID NO: 3251 - RNA, 21 nt, Artificial Sequence
  CXCR4 targeting guide RNA
auucuccuaaggcgcaaaaac

SEQ ID NO: 3252 - RNA, 21 nt, Artificial Sequence
  CXCR4 targeting guide RNA
caaagacucauucuccuaagg

SEQ ID NO: 3253 - RNA, 21 nt, Artificial Sequence
  CXCR4 targeting guide RNA
cauucuccuaaggcgcaaaaa

SEQ ID NO: 3254 - RNA, 21 nt, Artificial Sequence
  CXCR4 targeting guide RNA
ccuaaggcgcaaaaacuuaau

SEQ ID NO: 3255 - RNA, 21 nt, Artificial Sequence
  CXCR4 targeting guide RNA
ccuuaggagaaugagucuuug

SEQ ID NO: 3256 - RNA, 21 nt, Artificial Sequence
  CXCR4 targeting guide RNA
cgccuuaggagaaugagucuu

SEQ ID NO: 3257 - RNA, 21 nt, Artificial Sequence
  CXCR4 targeting guide RNA
cuaaggcgcaaaaacuuaauu

SEQ ID NO: 3258 - RNA, 21 nt, Artificial Sequence
  CXCR4 targeting guide RNA
cucauucuccuaaggcgcaaa

SEQ ID NO: 3259 - RNA, 21 nt, Artificial Sequence
  CXCR4 targeting guide RNA
cuccuaaggcgcaaaaacuua

SEQ ID NO: 3260 - RNA, 21 nt, Artificial Sequence
  CXCR4 targeting guide RNA
gaaaauuaaguuuuugcgccu

SEQ ID NO: 3261 - RNA, 21 nt, Artificial Sequence
  CXCR4 targeting guide RNA
gacucauucuccuaaggcgca

SEQ ID NO: 3262 - RNA, 21 nt, Artificial Sequence
  CXCR4 targeting guide RNA
gcaaagacucauucuccuaag

SEQ ID NO: 3263 - RNA, 21 nt, Artificial Sequence
  CXCR4 targeting guide RNA
gccuuaggagaaugagucuuu

SEQ ID NO: 3264 - RNA, 21 nt, Artificial Sequence
  CXCR4 targeting guide RNA
gcgccuuaggagaaugagucu

SEQ ID NO: 3265 - RNA, 21 nt, Artificial Sequence
  CXCR4 targeting guide RNA
ggaaaauuaaguuuuugcgcc

SEQ ID NO: 3266 - RNA, 21 nt, Artificial Sequence
  CXCR4 targeting guide RNA
ggcgcaaaaacuuaauuuucc

SEQ ID NO: 3267 - RNA, 21 nt, Artificial Sequence
  CXCR4 targeting guide RNA
guuuuugcgccuuaggagaau

SEQ ID NO: 3268 - RNA, 21 nt, Artificial Sequence
  CXCR4 targeting guide RNA
uaaguuuuugcgccuuaggag

SEQ ID NO: 3269 - RNA, 21 nt, Artificial Sequence
  CXCR4 targeting guide RNA
ucauucuccuaaggcgcaaaa

SEQ ID NO: 3270 - RNA, 21 nt, Artificial Sequence
  CXCR4 targeting guide RNA
uccuaaggcgcaaaaacuuaa

SEQ ID NO: 3271 - RNA, 21 nt, Artificial Sequence
  CXCR4 targeting guide RNA
ucuccuaaggcgcaaaaacuu

SEQ ID NO: 3272 - RNA, 21 nt, Artificial Sequence
  CXCR4 targeting guide RNA
ugcgccuuaggagaaugaguc

SEQ ID NO: 3273 - RNA, 21 nt, Artificial Sequence
  CXCR4 targeting guide RNA
uuaaguuuuugcgccuuagga

SEQ ID NO: 3274 - RNA, 21 nt, Artificial Sequence
  CXCR4 targeting guide RNA
uucuccuaaggcgcaaaaacu

SEQ ID NO: 3275 - RNA, 21 nt, Artificial Sequence
  CXCR4 targeting guide RNA
uugcgccuuaggagaaugagu

SEQ ID NO: 3276 - RNA, 21 nt, Artificial Sequence
  CXCR4 targeting guide RNA
uuugcgccuuaggagaaugag

SEQ ID NO: 3277 - RNA, 21 nt, Artificial Sequence
  CXCR4 targeting guide RNA
uuuugcgccuuaggagaauga

SEQ ID NO: 3278 - RNA, 21 nt, Artificial Sequence
  CXCR4 targeting guide RNA
uuuuugcgccuuaggagaaug

SEQ ID NO: 3279 - RNA, 22 nt, Artificial Sequence
  CXCR4 targeting guide RNA
aaagacucauucuccuaaggcg

SEQ ID NO: 3280 - RNA, 22 nt, Artificial Sequence
  CXCR4 targeting guide RNA
aaauuaaguuuuugcgccuuag

SEQ ID NO: 3281 - RNA, 22 nt, Artificial Sequence
  CXCR4 targeting guide RNA
aagacucauucuccuaaggcgc

SEQ ID NO: 3282 - RNA, 22 nt, Artificial Sequence
  CXCR4 targeting guide RNA
aaggcgcaaaaacuuaauuuuc

SEQ ID NO: 3283 - RNA, 22 nt, Artificial Sequence
  CXCR4 targeting guide RNA
aaguuuuugcgccuuaggagaa

SEQ ID NO: 3284 - RNA, 22 nt, Artificial Sequence
  CXCR4 targeting guide RNA
aauuaaguuuuugcgccuuagg

SEQ ID NO: 3285 - RNA, 22 nt, Artificial Sequence
  CXCR4 targeting guide RNA
acucauucuccuaaggcgcaaa

SEQ ID NO: 3286 - RNA, 22 nt, Artificial Sequence
  CXCR4 targeting guide RNA
agacucauucuccuaaggcgca

SEQ ID NO: 3287 - RNA, 22 nt, Artificial Sequence
  CXCR4 targeting guide RNA
aggcgcaaaaacuuaauuuucc

SEQ ID NO: 3288 - RNA, 22 nt, Artificial Sequence
  CXCR4 targeting guide RNA
aguuuuugcgccuuaggagaau

SEQ ID NO: 3289 - RNA, 22 nt, Artificial Sequence
  CXCR4 targeting guide RNA
auuaaguuuuugcgccuuagga

SEQ ID NO: 3290 - RNA, 22 nt, Artificial Sequence
  CXCR4 targeting guide RNA
auucuccuaaggcgcaaaaacu

SEQ ID NO: 3291 - RNA, 22 nt, Artificial Sequence
  CXCR4 targeting guide RNA
caaagacucauucuccuaaggc

SEQ ID NO: 3292 - RNA, 22 nt, Artificial Sequence
  CXCR4 targeting guide RNA
cauucuccuaaggcgcaaaaac

SEQ ID NO: 3293 - RNA, 22 nt, Artificial Sequence
  CXCR4 targeting guide RNA
ccuaaggcgcaaaaacuuaauu

SEQ ID NO: 3294 - RNA, 22 nt, Artificial Sequence
  CXCR4 targeting guide RNA
ccuuaggagaaugagucuuugc

SEQ ID NO: 3295 - RNA, 22 nt, Artificial Sequence
  CXCR4 targeting guide RNA
cgccuuaggagaaugagucuuu

SEQ ID NO: 3296 - RNA, 22 nt, Artificial Sequence
  CXCR4 targeting guide RNA
cuaaggcgcaaaaacuuaauuu

SEQ ID NO: 3297 - RNA, 22 nt, Artificial Sequence
  CXCR4 targeting guide RNA
cucauucuccuaaggcgcaaaa

SEQ ID NO: 3298 - RNA, 22 nt, Artificial Sequence
  CXCR4 targeting guide RNA
cuccuaaggcgcaaaaacuuaa

SEQ ID NO: 3299 - RNA, 22 nt, Artificial Sequence
  CXCR4 targeting guide RNA
gaaaauuaaguuuuugcgccuu

SEQ ID NO: 3300 - RNA, 22 nt, Artificial Sequence
  CXCR4 targeting guide RNA
gacucauucuccuaaggcgcaa

SEQ ID NO: 3301 - RNA, 22 nt, Artificial Sequence
  CXCR4 targeting guide RNA
gcaaagacucauucuccuaagg

SEQ ID NO: 3302 - RNA, 22 nt, Artificial Sequence
  CXCR4 targeting guide RNA
gccuuaggagaaugagucuuug

SEQ ID NO: 3303 - RNA, 22 nt, Artificial Sequence
  CXCR4 targeting guide RNA
gcgccuuaggagaaugagucuu

SEQ ID NO: 3304 - RNA, 22 nt, Artificial Sequence
  CXCR4 targeting guide RNA
ggaaaauuaaguuuuugcgccu

SEQ ID NO: 3305 - RNA, 22 nt, Artificial Sequence
  CXCR4 targeting guide RNA
ggcgcaaaaacuuaauuuuccc

SEQ ID NO: 3306 - RNA, 22 nt, Artificial Sequence
  CXCR4 targeting guide RNA
gggaaaauuaaguuuuugcgcc

SEQ ID NO: 3307 - RNA, 22 nt, Artificial Sequence
  CXCR4 targeting guide RNA
guuuuugcgccuuaggagaaug

SEQ ID NO: 3308 - RNA, 22 nt, Artificial Sequence
  CXCR4 targeting guide RNA
uaaguuuuugcgccuuaggaga

SEQ ID NO: 3309 - RNA, 22 nt, Artificial Sequence
  CXCR4 targeting guide RNA
ucauucuccuaaggcgcaaaaa

SEQ ID NO: 3310 - RNA, 22 nt, Artificial Sequence
  CXCR4 targeting guide RNA
uccuaaggcgcaaaaacuuaau

SEQ ID NO: 3311 - RNA, 22 nt, Artificial Sequence
  CXCR4 targeting guide RNA
ucuccuaaggcgcaaaaacuua

SEQ ID NO: 3312 - RNA, 22 nt, Artificial Sequence
  CXCR4 targeting guide RNA
ugcaaagacucauucuccuaag

SEQ ID NO: 3313 - RNA, 22 nt, Artificial Sequence
  CXCR4 targeting guide RNA
ugcgccuuaggagaaugagucu

SEQ ID NO: 3314 - RNA, 22 nt, Artificial Sequence
  CXCR4 targeting guide RNA
uuaaguuuuugcgccuuaggag

SEQ ID NO: 3315 - RNA, 22 nt, Artificial Sequence
  CXCR4 targeting guide RNA
uucuccuaaggcgcaaaaacuu

SEQ ID NO: 3316 - RNA, 22 nt, Artificial Sequence
  CXCR4 targeting guide RNA
uugcgccuuaggagaaugaguc

SEQ ID NO: 3317 - RNA, 22 nt, Artificial Sequence
  CXCR4 targeting guide RNA
uuugcgccuuaggagaaugagu

SEQ ID NO: 3318 - RNA, 22 nt, Artificial Sequence
  CXCR4 targeting guide RNA
uuuugcgccuuaggagaaugag

SEQ ID NO: 3319 - RNA, 22 nt, Artificial Sequence
  CXCR4 targeting guide RNA
uuuuugcgccuuaggagaauga

SEQ ID NO: 3320 - RNA, 20 nt, Artificial Sequence
  CXCR4 targeting guide RNA
aaacgguuuccccacuugca

SEQ ID NO: 3321 - RNA, 20 nt, Artificial Sequence
  CXCR4 targeting guide RNA
aacgguuuccccacuugcac

SEQ ID NO: 3322 - RNA, 20 nt, Artificial Sequence
  CXCR4 targeting guide RNA
aagacuggcaggugcaagug

SEQ ID NO: 3323 - RNA, 20 nt, Artificial Sequence
  CXCR4 targeting guide RNA
acgguuuccccacuugcacc

SEQ ID NO: 3324 - RNA, 20 nt, Artificial Sequence
  CXCR4 targeting guide RNA
acuggcaggugcaagugggg

SEQ ID NO: 3325 - RNA, 20 nt, Artificial Sequence
  CXCR4 targeting guide RNA
acuugcaccugccagucuuc

SEQ ID NO: 3326 - RNA, 20 nt, Artificial Sequence
  CXCR4 targeting guide RNA
agacuggcaggugcaagugg

SEQ ID NO: 3327 - RNA, 20 nt, Artificial Sequence
  CXCR4 targeting guide RNA
agagccaaacgguuucccca

SEQ ID NO: 3328 - RNA, 20 nt, Artificial Sequence
  CXCR4 targeting guide RNA
agccaaacgguuuccccacu

SEQ ID NO: 3329 - RNA, 20 nt, Artificial Sequence
  CXCR4 targeting guide RNA
aggugcaaguggggaaaccg

SEQ ID NO: 3330 - RNA, 20 nt, Artificial Sequence
  CXCR4 targeting guide RNA
caaacgguuuccccacuugc

SEQ ID NO: 3331 - RNA, 20 nt, Artificial Sequence
  CXCR4 targeting guide RNA
caaguggggaaaccguuugg

SEQ ID NO: 3332 - RNA, 20 nt, Artificial Sequence
  CXCR4 targeting guide RNA
cacuugcaccugccagucuu

SEQ ID NO: 3333 - RNA, 20 nt, Artificial Sequence
  CXCR4 targeting guide RNA
caggugcaaguggggaaacc

SEQ ID NO: 3334 - RNA, 20 nt, Artificial Sequence
  CXCR4 targeting guide RNA
ccaaacgguuuccccacuug

SEQ ID NO: 3335 - RNA, 20 nt, Artificial Sequence
  CXCR4 targeting guide RNA
ccacuugcaccugccagucu

SEQ ID NO: 3336 - RNA, 20 nt, Artificial Sequence
  CXCR4 targeting guide RNA
cccacuugcaccugccaguc

SEQ ID NO: 3337 - RNA, 20 nt, Artificial Sequence
  CXCR4 targeting guide RNA
ccccacuugcaccugccagu

SEQ ID NO: 3338 - RNA, 20 nt, Artificial Sequence
  CXCR4 targeting guide RNA
ccgccgcgaagacuggcagg

SEQ ID NO: 3339 - RNA, 20 nt, Artificial Sequence
  CXCR4 targeting guide RNA
ccgcgaagacuggcaggugc

SEQ ID NO: 3340 - RNA, 20 nt, Artificial Sequence
  CXCR4 targeting guide RNA
cgaagacuggcaggugcaag

SEQ ID NO: 3341 - RNA, 20 nt, Artificial Sequence
  CXCR4 targeting guide RNA
cgccgcgaagacuggcaggu

SEQ ID NO: 3342 - RNA, 20 nt, Artificial Sequence
  CXCR4 targeting guide RNA
cgcgaagacuggcaggugca

SEQ ID NO: 3343 - RNA, 20 nt, Artificial Sequence
  CXCR4 targeting guide RNA
cgguuuccccacuugcaccu

SEQ ID NO: 3344 - RNA, 20 nt, Artificial Sequence
  CXCR4 targeting guide RNA
cuggcaggugcaagugggga

SEQ ID NO: 3345 - RNA, 20 nt, Artificial Sequence
  CXCR4 targeting guide RNA
cuugcaccugccagucuucg

SEQ ID NO: 3346 - RNA, 20 nt, Artificial Sequence
  CXCR4 targeting guide RNA
gaagacuggcaggugcaagu

SEQ ID NO: 3347 - RNA, 20 nt, Artificial Sequence
  CXCR4 targeting guide RNA
gacuggcaggugcaaguggg

SEQ ID NO: 3348 - RNA, 20 nt, Artificial Sequence
  CXCR4 targeting guide RNA
gagccaaacgguuuccccac

SEQ ID NO: 3349 - RNA, 20 nt, Artificial Sequence
  CXCR4 targeting guide RNA
gcaaguggggaaaccguuug

SEQ ID NO: 3350 - RNA, 20 nt, Artificial Sequence
  CXCR4 targeting guide RNA
gcaggugcaaguggggaaac

SEQ ID NO: 3351 - RNA, 20 nt, Artificial Sequence
  CXCR4 targeting guide RNA
gccaaacgguuuccccacuu

SEQ ID NO: 3352 - RNA, 20 nt, Artificial Sequence
  CXCR4 targeting guide RNA
gccgcgaagacuggcaggug

SEQ ID NO: 3353 - RNA, 20 nt, Artificial Sequence
  CXCR4 targeting guide RNA
gcgaagacuggcaggugcaa

SEQ ID NO: 3354 - RNA, 20 nt, Artificial Sequence
  CXCR4 targeting guide RNA
ggcaggugcaaguggggaaa

SEQ ID NO: 3355 - RNA, 20 nt, Artificial Sequence
  CXCR4 targeting guide RNA
ggugcaaguggggaaaccgu

SEQ ID NO: 3356 - RNA, 20 nt, Artificial Sequence
  CXCR4 targeting guide RNA
gguuuccccacuugcaccug

SEQ ID NO: 3357 - RNA, 20 nt, Artificial Sequence
  CXCR4 targeting guide RNA
gugcaaguggggaaaccguu

SEQ ID NO: 3358 - RNA, 20 nt, Artificial Sequence
  CXCR4 targeting guide RNA
guuuccccacuugcaccugc

SEQ ID NO: 3359 - RNA, 20 nt, Artificial Sequence
  CXCR4 targeting guide RNA
uccccacuugcaccugccag

SEQ ID NO: 3360 - RNA, 20 nt, Artificial Sequence
  CXCR4 targeting guide RNA
ugcaaguggggaaaccguuu

SEQ ID NO: 3361 - RNA, 20 nt, Artificial Sequence
  CXCR4 targeting guide RNA
ugcaccugccagucuucgcg

SEQ ID NO: 3362 - RNA, 20 nt, Artificial Sequence
  CXCR4 targeting guide RNA
uggcaggugcaaguggggaa

SEQ ID NO: 3363 - RNA, 20 nt, Artificial Sequence
  CXCR4 targeting guide RNA
uuccccacuugcaccugcca

SEQ ID NO: 3364 - RNA, 20 nt, Artificial Sequence
  CXCR4 targeting guide RNA
uugcaccugccagucuucgc

SEQ ID NO: 3365 - RNA, 20 nt, Artificial Sequence
  CXCR4 targeting guide RNA
uuuccccacuugcaccugcc

SEQ ID NO: 3366 - RNA, 21 nt, Artificial Sequence
  CXCR4 targeting guide RNA
aaacgguuuccccacuugcac

SEQ ID NO: 3367 - RNA, 21 nt, Artificial Sequence
  CXCR4 targeting guide RNA
aacgguuuccccacuugcacc

SEQ ID NO: 3368 - RNA, 21 nt, Artificial Sequence
  CXCR4 targeting guide RNA
aagacuggcaggugcaagugg

SEQ ID NO: 3369 - RNA, 21 nt, Artificial Sequence
  CXCR4 targeting guide RNA
acgguuuccccacuugcaccu

SEQ ID NO: 3370 - RNA, 21 nt, Artificial Sequence
  CXCR4 targeting guide RNA
acuggcaggugcaagugggga

SEQ ID NO: 3371 - RNA, 21 nt, Artificial Sequence
  CXCR4 targeting guide RNA
acuugcaccugccagucuucg

SEQ ID NO: 3372 - RNA, 21 nt, Artificial Sequence
  CXCR4 targeting guide RNA
agacuggcaggugcaaguggg

SEQ ID NO: 3373 - RNA, 21 nt, Artificial Sequence
  CXCR4 targeting guide RNA
agagccaaacgguuuccccac

SEQ ID NO: 3374 - RNA, 21 nt, Artificial Sequence
  CXCR4 targeting guide RNA
agccaaacgguuuccccacuu

SEQ ID NO: 3375 - RNA, 21 nt, Artificial Sequence
  CXCR4 targeting guide RNA
aggugcaaguggggaaaccgu

SEQ ID NO: 3376 - RNA, 21 nt, Artificial Sequence
  CXCR4 targeting guide RNA
caaacgguuuccccacuugca

SEQ ID NO: 3377 - RNA, 21 nt, Artificial Sequence
  CXCR4 targeting guide RNA
caaguggggaaaccguuuggc

SEQ ID NO: 3378 - RNA, 21 nt, Artificial Sequence
  CXCR4 targeting guide RNA
cacuugcaccugccagucuuc

SEQ ID NO: 3379 - RNA, 21 nt, Artificial Sequence
  CXCR4 targeting guide RNA
caggugcaaguggggaaaccg

SEQ ID NO: 3380 - RNA, 21 nt, Artificial Sequence
  CXCR4 targeting guide RNA
ccaaacgguuuccccacuugc

SEQ ID NO: 3381 - RNA, 21 nt, Artificial Sequence
  CXCR4 targeting guide RNA
ccacuugcaccugccagucuu

SEQ ID NO: 3382 - RNA, 21 nt, Artificial Sequence
  CXCR4 targeting guide RNA
cccacuugcaccugccagucu

SEQ ID NO: 3383 - RNA, 21 nt, Artificial Sequence
  CXCR4 targeting guide RNA
ccccacuugcaccugccaguc

SEQ ID NO: 3384 - RNA, 21 nt, Artificial Sequence
  CXCR4 targeting guide RNA
ccgccgcgaagacuggcaggu

SEQ ID NO: 3385 - RNA, 21 nt, Artificial Sequence
  CXCR4 targeting guide RNA
ccgcgaagacuggcaggugca

SEQ ID NO: 3386 - RNA, 21 nt, Artificial Sequence
  CXCR4 targeting guide RNA
cgaagacuggcaggugcaagu

SEQ ID NO: 3387 - RNA, 21 nt, Artificial Sequence
  CXCR4 targeting guide RNA
cgccgcgaagacuggcaggug

SEQ ID NO: 3388 - RNA, 21 nt, Artificial Sequence
  CXCR4 targeting guide RNA
cgcgaagacuggcaggugcaa

SEQ ID NO: 3389 - RNA, 21 nt, Artificial Sequence
  CXCR4 targeting guide RNA
cgguuuccccacuugcaccug

SEQ ID NO: 3390 - RNA, 21 nt, Artificial Sequence
  CXCR4 targeting guide RNA
cuggcaggugcaaguggggaa

SEQ ID NO: 3391 - RNA, 21 nt, Artificial Sequence
  CXCR4 targeting guide RNA
cuugcaccugccagucuucgc

SEQ ID NO: 3392 - RNA, 21 nt, Artificial Sequence
  CXCR4 targeting guide RNA
gaagacuggcaggugcaagug

SEQ ID NO: 3393 - RNA, 21 nt, Artificial Sequence
  CXCR4 targeting guide RNA
gacuggcaggugcaagugggg

SEQ ID NO: 3394 - RNA, 21 nt, Artificial Sequence
  CXCR4 targeting guide RNA
gagagccaaacgguuucccca

SEQ ID NO: 3395 - RNA, 21 nt, Artificial Sequence
  CXCR4 targeting guide RNA
gagccaaacgguuuccccacu

SEQ ID NO: 3396 - RNA, 21 nt, Artificial Sequence
  CXCR4 targeting guide RNA
gcaaguggggaaaccguuugg

SEQ ID NO: 3397 - RNA, 21 nt, Artificial Sequence
  CXCR4 targeting guide RNA
gcaggugcaaguggggaaacc

SEQ ID NO: 3398 - RNA, 21 nt, Artificial Sequence
  CXCR4 targeting guide RNA
gccaaacgguuuccccacuug

SEQ ID NO: 3399 - RNA, 21 nt, Artificial Sequence
  CXCR4 targeting guide RNA
gccgccgcgaagacuggcagg

SEQ ID NO: 3400 - RNA, 21 nt, Artificial Sequence
  CXCR4 targeting guide RNA
gccgcgaagacuggcaggugc

SEQ ID NO: 3401 - RNA, 21 nt, Artificial Sequence
  CXCR4 targeting guide RNA
gcgaagacuggcaggugcaag

SEQ ID NO: 3402 - RNA, 21 nt, Artificial Sequence
  CXCR4 targeting guide RNA
ggcaggugcaaguggggaaac

SEQ ID NO: 3403 - RNA, 21 nt, Artificial Sequence
  CXCR4 targeting guide RNA
ggugcaaguggggaaaccguu

SEQ ID NO: 3404 - RNA, 21 nt, Artificial Sequence
  CXCR4 targeting guide RNA
gguuuccccacuugcaccugc

SEQ ID NO: 3405 - RNA, 21 nt, Artificial Sequence
  CXCR4 targeting guide RNA
gugcaaguggggaaaccguuu

SEQ ID NO: 3406 - RNA, 21 nt, Artificial Sequence
  CXCR4 targeting guide RNA
guuuccccacuugcaccugcc

SEQ ID NO: 3407 - RNA, 21 nt, Artificial Sequence
  CXCR4 targeting guide RNA
uccccacuugcaccugccagu

SEQ ID NO: 3408 - RNA, 21 nt, Artificial Sequence
  CXCR4 targeting guide RNA
ugcaaguggggaaaccguuug

SEQ ID NO: 3409 - RNA, 21 nt, Artificial Sequence
  CXCR4 targeting guide RNA
ugcaccugccagucuucgcgg

SEQ ID NO: 3410 - RNA, 21 nt, Artificial Sequence
  CXCR4 targeting guide RNA
uggcaggugcaaguggggaaa

SEQ ID NO: 3411 - RNA, 21 nt, Artificial Sequence
  CXCR4 targeting guide RNA
uuccccacuugcaccugccag

SEQ ID NO: 3412 - RNA, 21 nt, Artificial Sequence
  CXCR4 targeting guide RNA
uugcaccugccagucuucgcg

SEQ ID NO: 3413 - RNA, 21 nt, Artificial Sequence
  CXCR4 targeting guide RNA
uuuccccacuugcaccugcca

SEQ ID NO: 3414 - RNA, 22 nt, Artificial Sequence
  CXCR4 targeting guide RNA
aaacgguuuccccacuugcacc

SEQ ID NO: 3415 - RNA, 22 nt, Artificial Sequence
  CXCR4 targeting guide RNA
aacgguuuccccacuugcaccu

SEQ ID NO: 3416 - RNA, 22 nt, Artificial Sequence
  CXCR4 targeting guide RNA
aagacuggcaggugcaaguggg

SEQ ID NO: 3417 - RNA, 22 nt, Artificial Sequence
  CXCR4 targeting guide RNA
acgguuuccccacuugcaccug

SEQ ID NO: 3418 - RNA, 22 nt, Artificial Sequence
  CXCR4 targeting guide RNA
acuggcaggugcaaguggggaa

SEQ ID NO: 3419 - RNA, 22 nt, Artificial Sequence
  CXCR4 targeting guide RNA
acuugcaccugccagucuucgc

SEQ ID NO: 3420 - RNA, 22 nt, Artificial Sequence
  CXCR4 targeting guide RNA
agacuggcaggugcaagugggg

SEQ ID NO: 3421 - RNA, 22 nt, Artificial Sequence
  CXCR4 targeting guide RNA
agagagccaaacgguuucccca

SEQ ID NO: 3422 - RNA, 22 nt, Artificial Sequence
  CXCR4 targeting guide RNA
agagccaaacgguuuccccacu

SEQ ID NO: 3423 - RNA, 22 nt, Artificial Sequence
  CXCR4 targeting guide RNA
agccaaacgguuuccccacuug

SEQ ID NO: 3424 - RNA, 22 nt, Artificial Sequence
  CXCR4 targeting guide RNA
aggugcaaguggggaaaccguu

SEQ ID NO: 3425 - RNA, 22 nt, Artificial Sequence
  CXCR4 targeting guide RNA
caaacgguuuccccacuugcac

SEQ ID NO: 3426 - RNA, 22 nt, Artificial Sequence
  CXCR4 targeting guide RNA
caaguggggaaaccguuuggcu

SEQ ID NO: 3427 - RNA, 22 nt, Artificial Sequence
  CXCR4 targeting guide RNA
cacuugcaccugccagucuucg

SEQ ID NO: 3428 - RNA, 22 nt, Artificial Sequence
  CXCR4 targeting guide RNA
caggugcaaguggggaaaccgu

SEQ ID NO: 3429 - RNA, 22 nt, Artificial Sequence
  CXCR4 targeting guide RNA
ccaaacgguuuccccacuugca

SEQ ID NO: 3430 - RNA, 22 nt, Artificial Sequence
  CXCR4 targeting guide RNA
ccacuugcaccugccagucuuc

SEQ ID NO: 3431 - RNA, 22 nt, Artificial Sequence
  CXCR4 targeting guide RNA
cccacuugcaccugccagucuu

SEQ ID NO: 3432 - RNA, 22 nt, Artificial Sequence
  CXCR4 targeting guide RNA
ccccacuugcaccugccagucu

SEQ ID NO: 3433 - RNA, 22 nt, Artificial Sequence
  CXCR4 targeting guide RNA
ccgccgcgaagacuggcaggug

SEQ ID NO: 3434 - RNA, 22 nt, Artificial Sequence
  CXCR4 targeting guide RNA
ccgcgaagacuggcaggugcaa

SEQ ID NO: 3435 - RNA, 22 nt, Artificial Sequence
  CXCR4 targeting guide RNA
cgaagacuggcaggugcaagug

SEQ ID NO: 3436 - RNA, 22 nt, Artificial Sequence
  CXCR4 targeting guide RNA
cgccgccgcgaagacuggcagg

SEQ ID NO: 3437 - RNA, 22 nt, Artificial Sequence
  CXCR4 targeting guide RNA
cgccgcgaagacuggcaggugc

SEQ ID NO: 3438 - RNA, 22 nt, Artificial Sequence
  CXCR4 targeting guide RNA
cgcgaagacuggcaggugcaag

SEQ ID NO: 3439 - RNA, 22 nt, Artificial Sequence
  CXCR4 targeting guide RNA
cgguuuccccacuugcaccugc

SEQ ID NO: 3440 - RNA, 22 nt, Artificial Sequence
  CXCR4 targeting guide RNA
cuggcaggugcaaguggggaaa

SEQ ID NO: 3441 - RNA, 22 nt, Artificial Sequence
  CXCR4 targeting guide RNA
cuugcaccugccagucuucgcg

SEQ ID NO: 3442 - RNA, 22 nt, Artificial Sequence
  CXCR4 targeting guide RNA
gaagacuggcaggugcaagugg

SEQ ID NO: 3443 - RNA, 22 nt, Artificial Sequence
  CXCR4 targeting guide RNA
gacuggcaggugcaagugggga

SEQ ID NO: 3444 - RNA, 22 nt, Artificial Sequence
  CXCR4 targeting guide RNA
gagagccaaacgguuuccccac

SEQ ID NO: 3445 - RNA, 22 nt, Artificial Sequence
  CXCR4 targeting guide RNA
gagccaaacgguuuccccacuu

SEQ ID NO: 3446 - RNA, 22 nt, Artificial Sequence
  CXCR4 targeting guide RNA
gcaaguggggaaaccguuuggc

SEQ ID NO: 3447 - RNA, 22 nt, Artificial Sequence
  CXCR4 targeting guide RNA
gcaggugcaaguggggaaaccg

SEQ ID NO: 3448 - RNA, 22 nt, Artificial Sequence
  CXCR4 targeting guide RNA
gccaaacgguuuccccacuugc

SEQ ID NO: 3449 - RNA, 22 nt, Artificial Sequence
  CXCR4 targeting guide RNA
gccgccgcgaagacuggcaggu

SEQ ID NO: 3450 - RNA, 22 nt, Artificial Sequence
  CXCR4 targeting guide RNA
gccgcgaagacuggcaggugca

SEQ ID NO: 3451 - RNA, 22 nt, Artificial Sequence
  CXCR4 targeting guide RNA
gcgaagacuggcaggugcaagu

SEQ ID NO: 3452 - RNA, 22 nt, Artificial Sequence
  CXCR4 targeting guide RNA
ggcaggugcaaguggggaaacc

SEQ ID NO: 3453 - RNA, 22 nt, Artificial Sequence
  CXCR4 targeting guide RNA
ggugcaaguggggaaaccguuu

SEQ ID NO: 3454 - RNA, 22 nt, Artificial Sequence
  CXCR4 targeting guide RNA
gguuuccccacuugcaccugcc

SEQ ID NO: 3455 - RNA, 22 nt, Artificial Sequence
  CXCR4 targeting guide RNA
gugcaaguggggaaaccguuug

SEQ ID NO: 3456 - RNA, 22 nt, Artificial Sequence
  CXCR4 targeting guide RNA
guuuccccacuugcaccugcca

SEQ ID NO: 3457 - RNA, 22 nt, Artificial Sequence
  CXCR4 targeting guide RNA
uccccacuugcaccugccaguc

SEQ ID NO: 3458 - RNA, 22 nt, Artificial Sequence
  CXCR4 targeting guide RNA
ugcaaguggggaaaccguuugg

SEQ ID NO: 3459 - RNA, 22 nt, Artificial Sequence
  CXCR4 targeting guide RNA
ugcaccugccagucuucgcggc

SEQ ID NO: 3460 - RNA, 22 nt, Artificial Sequence
  CXCR4 targeting guide RNA
uggcaggugcaaguggggaaac

SEQ ID NO: 3461 - RNA, 22 nt, Artificial Sequence
  CXCR4 targeting guide RNA
uuccccacuugcaccugccagu

SEQ ID NO: 3462 - RNA, 22 nt, Artificial Sequence
  CXCR4 targeting guide RNA
uugcaccugccagucuucgcgg

SEQ ID NO: 3463 - RNA, 22 nt, Artificial Sequence
  CXCR4 targeting guide RNA
uuuccccacuugcaccugccag

SEQ ID NO: 3464 - RNA, 20 nt, Artificial Sequence
  CXCR4 targeting guide RNA
aaacgguuuccccacuggca

SEQ ID NO: 3465 - RNA, 20 nt, Artificial Sequence
  CXCR4 targeting guide RNA
aacgguuuccccacuggcac

SEQ ID NO: 3466 - RNA, 20 nt, Artificial Sequence
  CXCR4 targeting guide RNA
aagacuggcaggugccagug

SEQ ID NO: 3467 - RNA, 20 nt, Artificial Sequence
  CXCR4 targeting guide RNA
acgguuuccccacuggcacc

SEQ ID NO: 3468 - RNA, 20 nt, Artificial Sequence
  CXCR4 targeting guide RNA
acuggcaccugccagucuuc

SEQ ID NO: 3469 - RNA, 20 nt, Artificial Sequence
  CXCR4 targeting guide RNA
acuggcaggugccagugggg

SEQ ID NO: 3470 - RNA, 20 nt, Artificial Sequence
  CXCR4 targeting guide RNA
agacuggcaggugccagugg

SEQ ID NO: 3471 - RNA, 20 nt, Artificial Sequence
  CXCR4 targeting guide RNA
aggugccaguggggaaaccg

SEQ ID NO: 3472 - RNA, 20 nt, Artificial Sequence
  CXCR4 targeting guide RNA
caaacgguuuccccacuggc

SEQ ID NO: 3473 - RNA, 20 nt, Artificial Sequence
  CXCR4 targeting guide RNA
cacuggcaccugccagucuu

SEQ ID NO: 3474 - RNA, 20 nt, Artificial Sequence
  CXCR4 targeting guide RNA
caggugccaguggggaaacc

SEQ ID NO: 3475 - RNA, 20 nt, Artificial Sequence
  CXCR4 targeting guide RNA
ccaaacgguuuccccacugg

SEQ ID NO: 3476 - RNA, 20 nt, Artificial Sequence
  CXCR4 targeting guide RNA
ccacuggcaccugccagucu

SEQ ID NO: 3477 - RNA, 20 nt, Artificial Sequence
  CXCR4 targeting guide RNA
ccaguggggaaaccguuugg

SEQ ID NO: 3478 - RNA, 20 nt, Artificial Sequence
  CXCR4 targeting guide RNA
cccacuggcaccugccaguc

SEQ ID NO: 3479 - RNA, 20 nt, Artificial Sequence
  CXCR4 targeting guide RNA
ccccacuggcaccugccagu

SEQ ID NO: 3480 - RNA, 20 nt, Artificial Sequence
  CXCR4 targeting guide RNA
cgaagacuggcaggugccag

SEQ ID NO: 3481 - RNA, 20 nt, Artificial Sequence
  CXCR4 targeting guide RNA
cgcgaagacuggcaggugcc

SEQ ID NO: 3482 - RNA, 20 nt, Artificial Sequence
  CXCR4 targeting guide RNA
cgguuuccccacuggcaccu

SEQ ID NO: 3483 - RNA, 20 nt, Artificial Sequence
  CXCR4 targeting guide RNA
cuggcaccugccagucuucg

SEQ ID NO: 3484 - RNA, 20 nt, Artificial Sequence
  CXCR4 targeting guide RNA
cuggcaggugccagugggga

SEQ ID NO: 3485 - RNA, 20 nt, Artificial Sequence
  CXCR4 targeting guide RNA
gaagacuggcaggugccagu

SEQ ID NO: 3486 - RNA, 20 nt, Artificial Sequence
  CXCR4 targeting guide RNA
gacuggcaggugccaguggg

SEQ ID NO: 3487 - RNA, 20 nt, Artificial Sequence
  CXCR4 targeting guide RNA
gcaggugccaguggggaaac

SEQ ID NO: 3488 - RNA, 20 nt, Artificial Sequence
  CXCR4 targeting guide RNA
gccaaacgguuuccccacug

SEQ ID NO: 3489 - RNA, 20 nt, Artificial Sequence
  CXCR4 targeting guide RNA
gccaguggggaaaccguuug

SEQ ID NO: 3490 - RNA, 20 nt, Artificial Sequence
  CXCR4 targeting guide RNA
gcgaagacuggcaggugcca

SEQ ID NO: 3491 - RNA, 20 nt, Artificial Sequence
  CXCR4 targeting guide RNA
ggcaccugccagucuucgcg

SEQ ID NO: 3492 - RNA, 20 nt, Artificial Sequence
  CXCR4 targeting guide RNA
ggcaggugccaguggggaaa

SEQ ID NO: 3493 - RNA, 20 nt, Artificial Sequence
  CXCR4 targeting guide RNA
ggugccaguggggaaaccgu

SEQ ID NO: 3494 - RNA, 20 nt, Artificial Sequence
  CXCR4 targeting guide RNA
gguuuccccacuggcaccug

SEQ ID NO: 3495 - RNA, 20 nt, Artificial Sequence
  CXCR4 targeting guide RNA
gugccaguggggaaaccguu

SEQ ID NO: 3496 - RNA, 20 nt, Artificial Sequence
  CXCR4 targeting guide RNA
guuuccccacuggcaccugc

SEQ ID NO: 3497 - RNA, 20 nt, Artificial Sequence
  CXCR4 targeting guide RNA
uccccacuggcaccugccag

SEQ ID NO: 3498 - RNA, 20 nt, Artificial Sequence
  CXCR4 targeting guide RNA
ugccaguggggaaaccguuu

SEQ ID NO: 3499 - RNA, 20 nt, Artificial Sequence
  CXCR4 targeting guide RNA
uggcaccugccagucuucgc

SEQ ID NO: 3500 - RNA, 20 nt, Artificial Sequence
  CXCR4 targeting guide RNA
uggcaggugccaguggggaa

SEQ ID NO: 3501 - RNA, 20 nt, Artificial Sequence
  CXCR4 targeting guide RNA
uuccccacuggcaccugcca

SEQ ID NO: 3502 - RNA, 20 nt, Artificial Sequence
  CXCR4 targeting guide RNA
uuuccccacuggcaccugcc

SEQ ID NO: 3503 - RNA, 21 nt, Artificial Sequence
  CXCR4 targeting guide RNA
aaacgguuuccccacuggcac

SEQ ID NO: 3504 - RNA, 21 nt, Artificial Sequence
  CXCR4 targeting guide RNA
aacgguuuccccacuggcacc

SEQ ID NO: 3505 - RNA, 21 nt, Artificial Sequence
  CXCR4 targeting guide RNA
aagacuggcaggugccagugg

SEQ ID NO: 3506 - RNA, 21 nt, Artificial Sequence
  CXCR4 targeting guide RNA
acgguuuccccacuggcaccu

SEQ ID NO: 3507 - RNA, 21 nt, Artificial Sequence
  CXCR4 targeting guide RNA
acuggcaccugccagucuucg

SEQ ID NO: 3508 - RNA, 21 nt, Artificial Sequence
  CXCR4 targeting guide RNA
acuggcaggugccagugggga

SEQ ID NO: 3509 - RNA, 21 nt, Artificial Sequence
  CXCR4 targeting guide RNA
agacuggcaggugccaguggg

SEQ ID NO: 3510 - RNA, 21 nt, Artificial Sequence
  CXCR4 targeting guide RNA
agccaaacgguuuccccacug

SEQ ID NO: 3511 - RNA, 21 nt, Artificial Sequence
  CXCR4 targeting guide RNA
aggugccaguggggaaaccgu

SEQ ID NO: 3512 - RNA, 21 nt, Artificial Sequence
  CXCR4 targeting guide RNA
caaacgguuuccccacuggca

SEQ ID NO: 3513 - RNA, 21 nt, Artificial Sequence
  CXCR4 targeting guide RNA
cacuggcaccugccagucuuc

SEQ ID NO: 3514 - RNA, 21 nt, Artificial Sequence
  CXCR4 targeting guide RNA
caggugccaguggggaaaccg

SEQ ID NO: 3515 - RNA, 21 nt, Artificial Sequence
  CXCR4 targeting guide RNA
ccaaacgguuuccccacuggc

SEQ ID NO: 3516 - RNA, 21 nt, Artificial Sequence
  CXCR4 targeting guide RNA
ccacuggcaccugccagucuu

SEQ ID NO: 3517 - RNA, 21 nt, Artificial Sequence
  CXCR4 targeting guide RNA
ccaguggggaaaccguuuggc

SEQ ID NO: 3518 - RNA, 21 nt, Artificial Sequence
  CXCR4 targeting guide RNA
cccacuggcaccugccagucu

SEQ ID NO: 3519 - RNA, 21 nt, Artificial Sequence
  CXCR4 targeting guide RNA
ccccacuggcaccugccaguc

SEQ ID NO: 3520 - RNA, 21 nt, Artificial Sequence
  CXCR4 targeting guide RNA
ccgcgaagacuggcaggugcc

SEQ ID NO: 3521 - RNA, 21 nt, Artificial Sequence
  CXCR4 targeting guide RNA
cgaagacuggcaggugccagu

SEQ ID NO: 3522 - RNA, 21 nt, Artificial Sequence
  CXCR4 targeting guide RNA
cgcgaagacuggcaggugcca

SEQ ID NO: 3523 - RNA, 21 nt, Artificial Sequence
  CXCR4 targeting guide RNA
cgguuuccccacuggcaccug

SEQ ID NO: 3524 - RNA, 21 nt, Artificial Sequence
  CXCR4 targeting guide RNA
cuggcaccugccagucuucgc

SEQ ID NO: 3525 - RNA, 21 nt, Artificial Sequence
  CXCR4 targeting guide RNA
cuggcaggugccaguggggaa

SEQ ID NO: 3526 - RNA, 21 nt, Artificial Sequence
  CXCR4 targeting guide RNA
gaagacuggcaggugccagug

SEQ ID NO: 3527 - RNA, 21 nt, Artificial Sequence
  CXCR4 targeting guide RNA
gacuggcaggugccagugggg

SEQ ID NO: 3528 - RNA, 21 nt, Artificial Sequence
  CXCR4 targeting guide RNA
gcaggugccaguggggaaacc

SEQ ID NO: 3529 - RNA, 21 nt, Artificial Sequence
  CXCR4 targeting guide RNA
gccaaacgguuuccccacugg

SEQ ID NO: 3530 - RNA, 21 nt, Artificial Sequence
  CXCR4 targeting guide RNA
gccaguggggaaaccguuugg

SEQ ID NO: 3531 - RNA, 21 nt, Artificial Sequence
  CXCR4 targeting guide RNA
gcgaagacuggcaggugccag

SEQ ID NO: 3532 - RNA, 21 nt, Artificial Sequence
  CXCR4 targeting guide RNA
ggcaccugccagucuucgcgg

SEQ ID NO: 3533 - RNA, 21 nt, Artificial Sequence
  CXCR4 targeting guide RNA
ggcaggugccaguggggaaac

SEQ ID NO: 3534 - RNA, 21 nt, Artificial Sequence
  CXCR4 targeting guide RNA
ggugccaguggggaaaccguu

SEQ ID NO: 3535 - RNA, 21 nt, Artificial Sequence
  CXCR4 targeting guide RNA
gguuuccccacuggcaccugc

SEQ ID NO: 3536 - RNA, 21 nt, Artificial Sequence
  CXCR4 targeting guide RNA
gugccaguggggaaaccguuu

SEQ ID NO: 3537 - RNA, 21 nt, Artificial Sequence
  CXCR4 targeting guide RNA
guuuccccacuggcaccugcc

SEQ ID NO: 3538 - RNA, 21 nt, Artificial Sequence
  CXCR4 targeting guide RNA
uccccacuggcaccugccagu

SEQ ID NO: 3539 - RNA, 21 nt, Artificial Sequence
  CXCR4 targeting guide RNA
ugccaguggggaaaccguuug

SEQ ID NO: 3540 - RNA, 21 nt, Artificial Sequence
  CXCR4 targeting guide RNA
uggcaccugccagucuucgcg

SEQ ID NO: 3541 - RNA, 21 nt, Artificial Sequence
  CXCR4 targeting guide RNA
uggcaggugccaguggggaaa

SEQ ID NO: 3542 - RNA, 21 nt, Artificial Sequence
  CXCR4 targeting guide RNA
uuccccacuggcaccugccag

SEQ ID NO: 3543 - RNA, 21 nt, Artificial Sequence
  CXCR4 targeting guide RNA
uuuccccacuggcaccugcca

SEQ ID NO: 3544 - RNA, 22 nt, Artificial Sequence
  CXCR4 targeting guide RNA
aaacgguuuccccacuggcacc

SEQ ID NO: 3545 - RNA, 22 nt, Artificial Sequence
  CXCR4 targeting guide RNA
aacgguuuccccacuggcaccu

SEQ ID NO: 3546 - RNA, 22 nt, Artificial Sequence
  CXCR4 targeting guide RNA
aagacuggcaggugccaguggg

SEQ ID NO: 3547 - RNA, 22 nt, Artificial Sequence
  CXCR4 targeting guide RNA
acgguuuccccacuggcaccug

SEQ ID NO: 3548 - RNA, 22 nt, Artificial Sequence
  CXCR4 targeting guide RNA
acuggcaccugccagucuucgc

SEQ ID NO: 3549 - RNA, 22 nt, Artificial Sequence
  CXCR4 targeting guide RNA
acuggcaggugccaguggggaa

SEQ ID NO: 3550 - RNA, 22 nt, Artificial Sequence
  CXCR4 targeting guide RNA
agacuggcaggugccagugggg

SEQ ID NO: 3551 - RNA, 22 nt, Artificial Sequence
  CXCR4 targeting guide RNA
agccaaacgguuuccccacugg

SEQ ID NO: 3552 - RNA, 22 nt, Artificial Sequence
  CXCR4 targeting guide RNA
aggugccaguggggaaaccguu

SEQ ID NO: 3553 - RNA, 22 nt, Artificial Sequence
  CXCR4 targeting guide RNA
caaacgguuuccccacuggcac

SEQ ID NO: 3554 - RNA, 22 nt, Artificial Sequence
  CXCR4 targeting guide RNA
cacuggcaccugccagucuucg

SEQ ID NO: 3555 - RNA, 22 nt, Artificial Sequence
  CXCR4 targeting guide RNA
caggugccaguggggaaaccgu

SEQ ID NO: 3556 - RNA, 22 nt, Artificial Sequence
  CXCR4 targeting guide RNA
ccaaacgguuuccccacuggca

SEQ ID NO: 3557 - RNA, 22 nt, Artificial Sequence
  CXCR4 targeting guide RNA
ccacuggcaccugccagucuuc

SEQ ID NO: 3558 - RNA, 22 nt, Artificial Sequence
  CXCR4 targeting guide RNA
ccaguggggaaaccguuuggcu

SEQ ID NO: 3559 - RNA, 22 nt, Artificial Sequence
  CXCR4 targeting guide RNA
cccacuggcaccugccagucuu

SEQ ID NO: 3560 - RNA, 22 nt, Artificial Sequence
  CXCR4 targeting guide RNA
ccccacuggcaccugccagucu

SEQ ID NO: 3561 - RNA, 22 nt, Artificial Sequence
  CXCR4 targeting guide RNA
ccgcgaagacuggcaggugcca

SEQ ID NO: 3562 - RNA, 22 nt, Artificial Sequence
  CXCR4 targeting guide RNA
cgaagacuggcaggugccagug

SEQ ID NO: 3563 - RNA, 22 nt, Artificial Sequence
  CXCR4 targeting guide RNA
cgcgaagacuggcaggugccag

SEQ ID NO: 3564 - RNA, 22 nt, Artificial Sequence
  CXCR4 targeting guide RNA
cgguuuccccacuggcaccugc

SEQ ID NO: 3565 - RNA, 22 nt, Artificial Sequence
  CXCR4 targeting guide RNA
cuggcaccugccagucuucgcg

SEQ ID NO: 3566 - RNA, 22 nt, Artificial Sequence
  CXCR4 targeting guide RNA
cuggcaggugccaguggggaaa

SEQ ID NO: 3567 - RNA, 22 nt, Artificial Sequence
  CXCR4 targeting guide RNA
gaagacuggcaggugccagugg

SEQ ID NO: 3568 - RNA, 22 nt, Artificial Sequence
  CXCR4 targeting guide RNA
gacuggcaggugccagugggga

SEQ ID NO: 3569 - RNA, 22 nt, Artificial Sequence
  CXCR4 targeting guide RNA
gagccaaacgguuuccccacug

SEQ ID NO: 3570 - RNA, 22 nt, Artificial Sequence
  CXCR4 targeting guide RNA
gcaggugccaguggggaaaccg

SEQ ID NO: 3571 - RNA, 22 nt, Artificial Sequence
  CXCR4 targeting guide RNA
gccaaacgguuuccccacuggc

SEQ ID NO: 3572 - RNA, 22 nt, Artificial Sequence
  CXCR4 targeting guide RNA
gccaguggggaaaccguuuggc

SEQ ID NO: 3573 - RNA, 22 nt, Artificial Sequence
  CXCR4 targeting guide RNA
gccgcgaagacuggcaggugcc

SEQ ID NO: 3574 - RNA, 22 nt, Artificial Sequence
  CXCR4 targeting guide RNA
gcgaagacuggcaggugccagu

SEQ ID NO: 3575 - RNA, 22 nt, Artificial Sequence
  CXCR4 targeting guide RNA
ggcaccugccagucuucgcggc

SEQ ID NO: 3576 - RNA, 22 nt, Artificial Sequence
  CXCR4 targeting guide RNA
ggcaggugccaguggggaaacc

SEQ ID NO: 3577 - RNA, 22 nt, Artificial Sequence
  CXCR4 targeting guide RNA
ggugccaguggggaaaccguuu

SEQ ID NO: 3578 - RNA, 22 nt, Artificial Sequence
  CXCR4 targeting guide RNA
gguuuccccacuggcaccugcc

SEQ ID NO: 3579 - RNA, 22 nt, Artificial Sequence
  CXCR4 targeting guide RNA
gugccaguggggaaaccguuug

SEQ ID NO: 3580 - RNA, 22 nt, Artificial Sequence
  CXCR4 targeting guide RNA
guuuccccacuggcaccugcca

SEQ ID NO: 3581 - RNA, 22 nt, Artificial Sequence
  CXCR4 targeting guide RNA
uccccacuggcaccugccaguc

SEQ ID NO: 3582 - RNA, 22 nt, Artificial Sequence
  CXCR4 targeting guide RNA
ugccaguggggaaaccguuugg

SEQ ID NO: 3583 - RNA, 22 nt, Artificial Sequence
  CXCR4 targeting guide RNA
uggcaccugccagucuucgcgg

SEQ ID NO: 3584 - RNA, 22 nt, Artificial Sequence
  CXCR4 targeting guide RNA
uggcaggugccaguggggaaac

SEQ ID NO: 3585 - RNA, 22 nt, Artificial Sequence
  CXCR4 targeting guide RNA
uuccccacuggcaccugccagu

SEQ ID NO: 3586 - RNA, 22 nt, Artificial Sequence
  CXCR4 targeting guide RNA
uuuccccacuggcaccugccag

SEQ ID NO: 3587 - RNA, 20 nt, Artificial Sequence
  CXCR4 targeting guide RNA
aaaccuucccgccguccgaa

SEQ ID NO: 3588 - RNA, 20 nt, Artificial Sequence
  CXCR4 targeting guide RNA
aaccuucccgccguccgaag

SEQ ID NO: 3589 - RNA, 20 nt, Artificial Sequence
  CXCR4 targeting guide RNA
aagaggcgcgcuucggacgg

SEQ ID NO: 3590 - RNA, 20 nt, Artificial Sequence
  CXCR4 targeting guide RNA
aagcgcgccucuuccccacg

SEQ ID NO: 3591 - RNA, 20 nt, Artificial Sequence
  CXCR4 targeting guide RNA
accuucccgccguccgaagc

SEQ ID NO: 3592 - RNA, 20 nt, Artificial Sequence
  CXCR4 targeting guide RNA
agaggcgcgcuucggacggc

SEQ ID NO: 3593 - RNA, 20 nt, Artificial Sequence
  CXCR4 targeting guide RNA
agcgcgccucuuccccacgg

SEQ ID NO: 3594 - RNA, 20 nt, Artificial Sequence
  CXCR4 targeting guide RNA
aggcgcgcuucggacggcgg

SEQ ID NO: 3595 - RNA, 20 nt, Artificial Sequence
  CXCR4 targeting guide RNA
ccgaagcgcgccucuucccc

SEQ ID NO: 3596 - RNA, 20 nt, Artificial Sequence
  CXCR4 targeting guide RNA
ccgccguccgaagcgcgccu

SEQ ID NO: 3597 - RNA, 20 nt, Artificial Sequence
  CXCR4 targeting guide RNA
ccguccgaagcgcgccucuu

SEQ ID NO: 3598 - RNA, 20 nt, Artificial Sequence
  CXCR4 targeting guide RNA
ccguggggaagaggcgcgcu

SEQ ID NO: 3599 - RNA, 20 nt, Artificial Sequence
  CXCR4 targeting guide RNA
ccuucccgccguccgaagcg

SEQ ID NO: 3600 - RNA, 20 nt, Artificial Sequence
  CXCR4 targeting guide RNA
cgaagcgcgccucuucccca

SEQ ID NO: 3601 - RNA, 20 nt, Artificial Sequence
  CXCR4 targeting guide RNA
cgccguccgaagcgcgccuc

SEQ ID NO: 3602 - RNA, 20 nt, Artificial Sequence
  CXCR4 targeting guide RNA
cgcgccucuuccccacggcc

SEQ ID NO: 3603 - RNA, 20 nt, Artificial Sequence
  CXCR4 targeting guide RNA
cgcgcuucggacggcgggaa

SEQ ID NO: 3604 - RNA, 20 nt, Artificial Sequence
  CXCR4 targeting guide RNA
cgcggccguggggaagaggc

SEQ ID NO: 3605 - RNA, 20 nt, Artificial Sequence
  CXCR4 targeting guide RNA
cggccguggggaagaggcgc

SEQ ID NO: 3606 - RNA, 20 nt, Artificial Sequence
  CXCR4 targeting guide RNA
cguccgaagcgcgccucuuc

SEQ ID NO: 3607 - RNA, 20 nt, Artificial Sequence
  CXCR4 targeting guide RNA
cguggggaagaggcgcgcuu

SEQ ID NO: 3608 - RNA, 20 nt, Artificial Sequence
  CXCR4 targeting guide RNA
cucgcggccguggggaagag

SEQ ID NO: 3609 - RNA, 20 nt, Artificial Sequence
  CXCR4 targeting guide RNA
cuucccgccguccgaagcgc

SEQ ID NO: 3610 - RNA, 20 nt, Artificial Sequence
  CXCR4 targeting guide RNA
gaagaggcgcgcuucggacg

SEQ ID NO: 3611 - RNA, 20 nt, Artificial Sequence
  CXCR4 targeting guide RNA
gaagcgcgccucuuccccac

SEQ ID NO: 3612 - RNA, 20 nt, Artificial Sequence
  CXCR4 targeting guide RNA
gaggcgcgcuucggacggcg

SEQ ID NO: 3613 - RNA, 20 nt, Artificial Sequence
  CXCR4 targeting guide RNA
gccguccgaagcgcgccucu

SEQ ID NO: 3614 - RNA, 20 nt, Artificial Sequence
  CXCR4 targeting guide RNA
gccguggggaagaggcgcgc

SEQ ID NO: 3615 - RNA, 20 nt, Artificial Sequence
  CXCR4 targeting guide RNA
gcgccucuuccccacggccg

SEQ ID NO: 3616 - RNA, 20 nt, Artificial Sequence
  CXCR4 targeting guide RNA
gcgcgccucuuccccacggc

SEQ ID NO: 3617 - RNA, 20 nt, Artificial Sequence
  CXCR4 targeting guide RNA
gcgcgcuucggacggcggga

SEQ ID NO: 3618 - RNA, 20 nt, Artificial Sequence
  CXCR4 targeting guide RNA
gcgcuucggacggcgggaag

SEQ ID NO: 3619 - RNA, 20 nt, Artificial Sequence
  CXCR4 targeting guide RNA
gcggccguggggaagaggcg

SEQ ID NO: 3620 - RNA, 20 nt, Artificial Sequence
  CXCR4 targeting guide RNA
ggaagaggcgcgcuucggac

SEQ ID NO: 3621 - RNA, 20 nt, Artificial Sequence
  CXCR4 targeting guide RNA
ggccguggggaagaggcgcg

SEQ ID NO: 3622 - RNA, 20 nt, Artificial Sequence
  CXCR4 targeting guide RNA
gggaagaggcgcgcuucgga

SEQ ID NO: 3623 - RNA, 20 nt, Artificial Sequence
  CXCR4 targeting guide RNA
ggggaagaggcgcgcuucgg

SEQ ID NO: 3624 - RNA, 20 nt, Artificial Sequence
  CXCR4 targeting guide RNA
guccgaagcgcgccucuucc

SEQ ID NO: 3625 - RNA, 20 nt, Artificial Sequence
  CXCR4 targeting guide RNA
guggggaagaggcgcgcuuc

SEQ ID NO: 3626 - RNA, 20 nt, Artificial Sequence
  CXCR4 targeting guide RNA
ucccgccguccgaagcgcgc

SEQ ID NO: 3627 - RNA, 20 nt, Artificial Sequence
  CXCR4 targeting guide RNA
uccgaagcgcgccucuuccc

SEQ ID NO: 3628 - RNA, 20 nt, Artificial Sequence
  CXCR4 targeting guide RNA
ucgcggccguggggaagagg

SEQ ID NO: 3629 - RNA, 20 nt, Artificial Sequence
  CXCR4 targeting guide RNA
uggggaagaggcgcgcuucg

SEQ ID NO: 3630 - RNA, 20 nt, Artificial Sequence
  CXCR4 targeting guide RNA
uucccgccguccgaagcgcg

SEQ ID NO: 3631 - RNA, 21 nt, Artificial Sequence
  CXCR4 targeting guide RNA
aaaaccuucccgccguccgaa

SEQ ID NO: 3632 - RNA, 21 nt, Artificial Sequence
  CXCR4 targeting guide RNA
aaaccuucccgccguccgaag

SEQ ID NO: 3633 - RNA, 21 nt, Artificial Sequence
  CXCR4 targeting guide RNA
aaccuucccgccguccgaagc

SEQ ID NO: 3634 - RNA, 21 nt, Artificial Sequence
  CXCR4 targeting guide RNA
aagaggcgcgcuucggacggc

SEQ ID NO: 3635 - RNA, 21 nt, Artificial Sequence
  CXCR4 targeting guide RNA
aagcgcgccucuuccccacgg

SEQ ID NO: 3636 - RNA, 21 nt, Artificial Sequence
  CXCR4 targeting guide RNA
accuucccgccguccgaagcg

SEQ ID NO: 3637 - RNA, 21 nt, Artificial Sequence
  CXCR4 targeting guide RNA
acucgcggccguggggaagag

SEQ ID NO: 3638 - RNA, 21 nt, Artificial Sequence
  CXCR4 targeting guide RNA
agaggcgcgcuucggacggcg

SEQ ID NO: 3639 - RNA, 21 nt, Artificial Sequence
  CXCR4 targeting guide RNA
agcgcgccucuuccccacggc

SEQ ID NO: 3640 - RNA, 21 nt, Artificial Sequence
  CXCR4 targeting guide RNA
ccgaagcgcgccucuucccca

SEQ ID NO: 3641 - RNA, 21 nt, Artificial Sequence
  CXCR4 targeting guide RNA
ccguccgaagcgcgccucuuc

SEQ ID NO: 3642 - RNA, 21 nt, Artificial Sequence
  CXCR4 targeting guide RNA
ccguggggaagaggcgcgcuu

SEQ ID NO: 3643 - RNA, 21 nt, Artificial Sequence
  CXCR4 targeting guide RNA
ccuucccgccguccgaagcgc

SEQ ID NO: 3644 - RNA, 21 nt, Artificial Sequence
  CXCR4 targeting guide RNA
cgaagcgcgccucuuccccac

SEQ ID NO: 3645 - RNA, 21 nt, Artificial Sequence
  CXCR4 targeting guide RNA
cgccguccgaagcgcgccucu

SEQ ID NO: 3646 - RNA, 21 nt, Artificial Sequence
  CXCR4 targeting guide RNA
cgcgcuucggacggcgggaag

SEQ ID NO: 3647 - RNA, 21 nt, Artificial Sequence
  CXCR4 targeting guide RNA
cguccgaagcgcgccucuucc

SEQ ID NO: 3648 - RNA, 21 nt, Artificial Sequence
  CXCR4 targeting guide RNA
cguggggaagaggcgcgcuuc

SEQ ID NO: 3649 - RNA, 21 nt, Artificial Sequence
  CXCR4 targeting guide RNA
cucgcggccguggggaagagg

SEQ ID NO: 3650 - RNA, 21 nt, Artificial Sequence
  CXCR4 targeting guide RNA
cuucccgccguccgaagcgcg

SEQ ID NO: 3651 - RNA, 21 nt, Artificial Sequence
  CXCR4 targeting guide RNA
gaagaggcgcgcuucggacgg

SEQ ID NO: 3652 - RNA, 21 nt, Artificial Sequence
  CXCR4 targeting guide RNA
gaagcgcgccucuuccccacg

SEQ ID NO: 3653 - RNA, 21 nt, Artificial Sequence
  CXCR4 targeting guide RNA
gccguccgaagcgcgccucuu

SEQ ID NO: 3654 - RNA, 21 nt, Artificial Sequence
  CXCR4 targeting guide RNA
gccguggggaagaggcgcgcu

SEQ ID NO: 3655 - RNA, 21 nt, Artificial Sequence
  CXCR4 targeting guide RNA
gcgcgcuucggacggcgggaa

SEQ ID NO: 3656 - RNA, 21 nt, Artificial Sequence
  CXCR4 targeting guide RNA
gcgcuucggacggcgggaagg

SEQ ID NO: 3657 - RNA, 21 nt, Artificial Sequence
  CXCR4 targeting guide RNA
ggaagaggcgcgcuucggacg

SEQ ID NO: 3658 - RNA, 21 nt, Artificial Sequence
  CXCR4 targeting guide RNA
gggaagaggcgcgcuucggac

SEQ ID NO: 3659 - RNA, 21 nt, Artificial Sequence
  CXCR4 targeting guide RNA
ggggaagaggcgcgcuucgga

SEQ ID NO: 3660 - RNA, 21 nt, Artificial Sequence
  CXCR4 targeting guide RNA
guccgaagcgcgccucuuccc

SEQ ID NO: 3661 - RNA, 21 nt, Artificial Sequence
  CXCR4 targeting guide RNA
guggggaagaggcgcgcuucg

SEQ ID NO: 3662 - RNA, 21 nt, Artificial Sequence
  CXCR4 targeting guide RNA
uccgaagcgcgccucuucccc

SEQ ID NO: 3663 - RNA, 21 nt, Artificial Sequence
  CXCR4 targeting guide RNA
ucgcggccguggggaagaggc

SEQ ID NO: 3664 - RNA, 21 nt, Artificial Sequence
  CXCR4 targeting guide RNA
uggggaagaggcgcgcuucgg

SEQ ID NO: 3665 - RNA, 21 nt, Artificial Sequence
  CXCR4 targeting guide RNA
uucccgccguccgaagcgcgc

SEQ ID NO: 3666 - RNA, 22 nt, Artificial Sequence
  CXCR4 targeting guide RNA
aaaaccuucccgccguccgaag

SEQ ID NO: 3667 - RNA, 22 nt, Artificial Sequence
  CXCR4 targeting guide RNA
aaaccuucccgccguccgaagc

SEQ ID NO: 3668 - RNA, 22 nt, Artificial Sequence
  CXCR4 targeting guide RNA
aaccuucccgccguccgaagcg

SEQ ID NO: 3669 - RNA, 22 nt, Artificial Sequence
  CXCR4 targeting guide RNA
aagaggcgcgcuucggacggcg

SEQ ID NO: 3670 - RNA, 22 nt, Artificial Sequence
  CXCR4 targeting guide RNA
aagcgcgccucuuccccacggc

SEQ ID NO: 3671 - RNA, 22 nt, Artificial Sequence
  CXCR4 targeting guide RNA
accuucccgccguccgaagcgc

SEQ ID NO: 3672 - RNA, 22 nt, Artificial Sequence
  CXCR4 targeting guide RNA
acucgcggccguggggaagagg

SEQ ID NO: 3673 - RNA, 22 nt, Artificial Sequence
  CXCR4 targeting guide RNA
agaggcgcgcuucggacggcgg

SEQ ID NO: 3674 - RNA, 22 nt, Artificial Sequence
  CXCR4 targeting guide RNA
agcgcgccucuuccccacggcc

SEQ ID NO: 3675 - RNA, 22 nt, Artificial Sequence
  CXCR4 targeting guide RNA
aggcgcgcuucggacggcggga

SEQ ID NO: 3676 - RNA, 22 nt, Artificial Sequence
  CXCR4 targeting guide RNA
cacucgcggccguggggaagag

SEQ ID NO: 3677 - RNA, 22 nt, Artificial Sequence
  CXCR4 targeting guide RNA
ccgaagcgcgccucuuccccac

SEQ ID NO: 3678 - RNA, 22 nt, Artificial Sequence
  CXCR4 targeting guide RNA
ccgccguccgaagcgcgccucu

SEQ ID NO: 3679 - RNA, 22 nt, Artificial Sequence
  CXCR4 targeting guide RNA
ccguccgaagcgcgccucuucc

SEQ ID NO: 3680 - RNA, 22 nt, Artificial Sequence
  CXCR4 targeting guide RNA
ccguggggaagaggcgcgcuuc

SEQ ID NO: 3681 - RNA, 22 nt, Artificial Sequence
  CXCR4 targeting guide RNA
ccuucccgccguccgaagcgcg

SEQ ID NO: 3682 - RNA, 22 nt, Artificial Sequence
  CXCR4 targeting guide RNA
cgaagcgcgccucuuccccacg

SEQ ID NO: 3683 - RNA, 22 nt, Artificial Sequence
  CXCR4 targeting guide RNA
cgccguccgaagcgcgccucuu

SEQ ID NO: 3684 - RNA, 22 nt, Artificial Sequence
  CXCR4 targeting guide RNA
cgcgcuucggacggcgggaagg

SEQ ID NO: 3685 - RNA, 22 nt, Artificial Sequence
  CXCR4 targeting guide RNA
cguccgaagcgcgccucuuccc

SEQ ID NO: 3686 - RNA, 22 nt, Artificial Sequence
  CXCR4 targeting guide RNA
cguggggaagaggcgcgcuucg

SEQ ID NO: 3687 - RNA, 22 nt, Artificial Sequence
  CXCR4 targeting guide RNA
cucgcggccguggggaagaggc

SEQ ID NO: 3688 - RNA, 22 nt, Artificial Sequence
  CXCR4 targeting guide RNA
cuucccgccguccgaagcgcgc

SEQ ID NO: 3689 - RNA, 22 nt, Artificial Sequence
  CXCR4 targeting guide RNA
gaaaaccuucccgccguccgaa

SEQ ID NO: 3690 - RNA, 22 nt, Artificial Sequence
  CXCR4 targeting guide RNA
gaagaggcgcgcuucggacggc

SEQ ID NO: 3691 - RNA, 22 nt, Artificial Sequence
  CXCR4 targeting guide RNA
gaagcgcgccucuuccccacgg

SEQ ID NO: 3692 - RNA, 22 nt, Artificial Sequence
  CXCR4 targeting guide RNA
gccguccgaagcgcgccucuuc

SEQ ID NO: 3693 - RNA, 22 nt, Artificial Sequence
  CXCR4 targeting guide RNA
gccguggggaagaggcgcgcuu

SEQ ID NO: 3694 - RNA, 22 nt, Artificial Sequence
  CXCR4 targeting guide RNA
gcgcgcuucggacggcgggaag

SEQ ID NO: 3695 - RNA, 22 nt, Artificial Sequence
  CXCR4 targeting guide RNA
gcgcuucggacggcgggaaggu

SEQ ID NO: 3696 - RNA, 22 nt, Artificial Sequence
  CXCR4 targeting guide RNA
ggaagaggcgcgcuucggacgg

SEQ ID NO: 3697 - RNA, 22 nt, Artificial Sequence
  CXCR4 targeting guide RNA
ggccguggggaagaggcgcgcu

SEQ ID NO: 3698 - RNA, 22 nt, Artificial Sequence
  CXCR4 targeting guide RNA
ggcgcgcuucggacggcgggaa

SEQ ID NO: 3699 - RNA, 22 nt, Artificial Sequence
  CXCR4 targeting guide RNA
gggaagaggcgcgcuucggacg

SEQ ID NO: 3700 - RNA, 22 nt, Artificial Sequence
  CXCR4 targeting guide RNA
ggggaagaggcgcgcuucggac

SEQ ID NO: 3701 - RNA, 22 nt, Artificial Sequence
  CXCR4 targeting guide RNA
guccgaagcgcgccucuucccc

SEQ ID NO: 3702 - RNA, 22 nt, Artificial Sequence
  CXCR4 targeting guide RNA
guggggaagaggcgcgcuucgg

SEQ ID NO: 3703 - RNA, 22 nt, Artificial Sequence
  CXCR4 targeting guide RNA
ucccgccguccgaagcgcgccu

SEQ ID NO: 3704 - RNA, 22 nt, Artificial Sequence
  CXCR4 targeting guide RNA
uccgaagcgcgccucuucccca

SEQ ID NO: 3705 - RNA, 22 nt, Artificial Sequence
  CXCR4 targeting guide RNA
ucgcggccguggggaagaggcg

SEQ ID NO: 3706 - RNA, 22 nt, Artificial Sequence
  CXCR4 targeting guide RNA
uggggaagaggcgcgcuucgga

SEQ ID NO: 3707 - RNA, 22 nt, Artificial Sequence
  CXCR4 targeting guide RNA
uucccgccguccgaagcgcgcc

SEQ ID NO: 3708 - RNA, 20 nt, Artificial Sequence
  CXCR4 targeting guide RNA
aagaggcacgcuucggacgg

SEQ ID NO: 3709 - RNA, 20 nt, Artificial Sequence
  CXCR4 targeting guide RNA
aagcgugccucuuccccacg

SEQ ID NO: 3710 - RNA, 20 nt, Artificial Sequence
  CXCR4 targeting guide RNA
acgcuucggacggcgggaag

SEQ ID NO: 3711 - RNA, 20 nt, Artificial Sequence
  CXCR4 targeting guide RNA
agaggcacgcuucggacggc

SEQ ID NO: 3712 - RNA, 20 nt, Artificial Sequence
  CXCR4 targeting guide RNA
agcgugccucuuccccacgg

SEQ ID NO: 3713 - RNA, 20 nt, Artificial Sequence
  CXCR4 targeting guide RNA
aggcacgcuucggacggcgg

SEQ ID NO: 3714 - RNA, 20 nt, Artificial Sequence
  CXCR4 targeting guide RNA
cacgcuucggacggcgggaa

SEQ ID NO: 3715 - RNA, 20 nt, Artificial Sequence
  CXCR4 targeting guide RNA
cccgccguccgaagcgugcc

SEQ ID NO: 3716 - RNA, 20 nt, Artificial Sequence
  CXCR4 targeting guide RNA
ccgaagcgugccucuucccc

SEQ ID NO: 3717 - RNA, 20 nt, Artificial Sequence
  CXCR4 targeting guide RNA
ccgccguccgaagcgugccu

SEQ ID NO: 3718 - RNA, 20 nt, Artificial Sequence
  CXCR4 targeting guide RNA
ccguccgaagcgugccucuu

SEQ ID NO: 3719 - RNA, 20 nt, Artificial Sequence
  CXCR4 targeting guide RNA
ccguggggaagaggcacgcu

SEQ ID NO: 3720 - RNA, 20 nt, Artificial Sequence
  CXCR4 targeting guide RNA
cgaagcgugccucuucccca

SEQ ID NO: 3721 - RNA, 20 nt, Artificial Sequence
  CXCR4 targeting guide RNA
cgccguccgaagcgugccuc

SEQ ID NO: 3722 - RNA, 20 nt, Artificial Sequence
  CXCR4 targeting guide RNA
cggccguggggaagaggcac

SEQ ID NO: 3723 - RNA, 20 nt, Artificial Sequence
  CXCR4 targeting guide RNA
cguccgaagcgugccucuuc

SEQ ID NO: 3724 - RNA, 20 nt, Artificial Sequence
  CXCR4 targeting guide RNA
cgugccucuuccccacggcc

SEQ ID NO: 3725 - RNA, 20 nt, Artificial Sequence
  CXCR4 targeting guide RNA
cguggggaagaggcacgcuu

SEQ ID NO: 3726 - RNA, 20 nt, Artificial Sequence
  CXCR4 targeting guide RNA
cuucccgccguccgaagcgu

SEQ ID NO: 3727 - RNA, 20 nt, Artificial Sequence
  CXCR4 targeting guide RNA
gaagaggcacgcuucggacg

SEQ ID NO: 3728 - RNA, 20 nt, Artificial Sequence
  CXCR4 targeting guide RNA
gaagcgugccucuuccccac

SEQ ID NO: 3729 - RNA, 20 nt, Artificial Sequence
  CXCR4 targeting guide RNA
gaggcacgcuucggacggcg

SEQ ID NO: 3730 - RNA, 20 nt, Artificial Sequence
  CXCR4 targeting guide RNA
gcacgcuucggacggcggga

SEQ ID NO: 3731 - RNA, 20 nt, Artificial Sequence
  CXCR4 targeting guide RNA
gccguccgaagcgugccucu

SEQ ID NO: 3732 - RNA, 20 nt, Artificial Sequence
  CXCR4 targeting guide RNA
gccguggggaagaggcacgc

SEQ ID NO: 3733 - RNA, 20 nt, Artificial Sequence
  CXCR4 targeting guide RNA
gcggccguggggaagaggca

SEQ ID NO: 3734 - RNA, 20 nt, Artificial Sequence
  CXCR4 targeting guide RNA
gcgugccucuuccccacggc

SEQ ID NO: 3735 - RNA, 20 nt, Artificial Sequence
  CXCR4 targeting guide RNA
ggaagaggcacgcuucggac

SEQ ID NO: 3736 - RNA, 20 nt, Artificial Sequence
  CXCR4 targeting guide RNA
ggcacgcuucggacggcggg

SEQ ID NO: 3737 - RNA, 20 nt, Artificial Sequence
  CXCR4 targeting guide RNA
ggccguggggaagaggcacg

SEQ ID NO: 3738 - RNA, 20 nt, Artificial Sequence
  CXCR4 targeting guide RNA
gggaagaggcacgcuucgga

SEQ ID NO: 3739 - RNA, 20 nt, Artificial Sequence
  CXCR4 targeting guide RNA
ggggaagaggcacgcuucgg

SEQ ID NO: 3740 - RNA, 20 nt, Artificial Sequence
  CXCR4 targeting guide RNA
guccgaagcgugccucuucc

SEQ ID NO: 3741 - RNA, 20 nt, Artificial Sequence
  CXCR4 targeting guide RNA
gugccucuuccccacggccg

SEQ ID NO: 3742 - RNA, 20 nt, Artificial Sequence
  CXCR4 targeting guide RNA
guggggaagaggcacgcuuc

SEQ ID NO: 3743 - RNA, 20 nt, Artificial Sequence
  CXCR4 targeting guide RNA
ucccgccguccgaagcgugc

SEQ ID NO: 3744 - RNA, 20 nt, Artificial Sequence
  CXCR4 targeting guide RNA
uccgaagcgugccucuuccc

SEQ ID NO: 3745 - RNA, 20 nt, Artificial Sequence
  CXCR4 targeting guide RNA
uggggaagaggcacgcuucg

SEQ ID NO: 3746 - RNA, 20 nt, Artificial Sequence
  CXCR4 targeting guide RNA
uucccgccguccgaagcgug

SEQ ID NO: 3747 - RNA, 21 nt, Artificial Sequence
  CXCR4 targeting guide RNA
aagaggcacgcuucggacggc

SEQ ID NO: 3748 - RNA, 21 nt, Artificial Sequence
  CXCR4 targeting guide RNA
aagcgugccucuuccccacgg

SEQ ID NO: 3749 - RNA, 21 nt, Artificial Sequence
  CXCR4 targeting guide RNA
acgcuucggacggcgggaagg

SEQ ID NO: 3750 - RNA, 21 nt, Artificial Sequence
  CXCR4 targeting guide RNA
agaggcacgcuucggacggcg

SEQ ID NO: 3751 - RNA, 21 nt, Artificial Sequence
  CXCR4 targeting guide RNA
agcgugccucuuccccacggc

SEQ ID NO: 3752 - RNA, 21 nt, Artificial Sequence
  CXCR4 targeting guide RNA
aggcacgcuucggacggcggg

SEQ ID NO: 3753 - RNA, 21 nt, Artificial Sequence
  CXCR4 targeting guide RNA
cacgcuucggacggcgggaag

SEQ ID NO: 3754 - RNA, 21 nt, Artificial Sequence
  CXCR4 targeting guide RNA
cccgccguccgaagcgugccu

SEQ ID NO: 3755 - RNA, 21 nt, Artificial Sequence
  CXCR4 targeting guide RNA
ccgaagcgugccucuucccca

SEQ ID NO: 3756 - RNA, 21 nt, Artificial Sequence
  CXCR4 targeting guide RNA
ccgccguccgaagcgugccuc

SEQ ID NO: 3757 - RNA, 21 nt, Artificial Sequence
  CXCR4 targeting guide RNA
ccguccgaagcgugccucuuc

SEQ ID NO: 3758 - RNA, 21 nt, Artificial Sequence
  CXCR4 targeting guide RNA
ccguggggaagaggcacgcuu

SEQ ID NO: 3759 - RNA, 21 nt, Artificial Sequence
  CXCR4 targeting guide RNA
ccuucccgccguccgaagcgu

SEQ ID NO: 3760 - RNA, 21 nt, Artificial Sequence
  CXCR4 targeting guide RNA
cgaagcgugccucuuccccac

SEQ ID NO: 3761 - RNA, 21 nt, Artificial Sequence
  CXCR4 targeting guide RNA
cgccguccgaagcgugccucu

SEQ ID NO: 3762 - RNA, 21 nt, Artificial Sequence
  CXCR4 targeting guide RNA
cgcggccguggggaagaggca

SEQ ID NO: 3763 - RNA, 21 nt, Artificial Sequence
  CXCR4 targeting guide RNA
cggccguggggaagaggcacg

SEQ ID NO: 3764 - RNA, 21 nt, Artificial Sequence
  CXCR4 targeting guide RNA
cguccgaagcgugccucuucc

SEQ ID NO: 3765 - RNA, 21 nt, Artificial Sequence
  CXCR4 targeting guide RNA
cgugccucuuccccacggccg

SEQ ID NO: 3766 - RNA, 21 nt, Artificial Sequence
  CXCR4 targeting guide RNA
cguggggaagaggcacgcuuc

SEQ ID NO: 3767 - RNA, 21 nt, Artificial Sequence
  CXCR4 targeting guide RNA
cuucccgccguccgaagcgug

SEQ ID NO: 3768 - RNA, 21 nt, Artificial Sequence
  CXCR4 targeting guide RNA
gaagaggcacgcuucggacgg

SEQ ID NO: 3769 - RNA, 21 nt, Artificial Sequence
  CXCR4 targeting guide RNA
gaagcgugccucuuccccacg

SEQ ID NO: 3770 - RNA, 21 nt, Artificial Sequence
  CXCR4 targeting guide RNA
gaggcacgcuucggacggcgg

SEQ ID NO: 3771 - RNA, 21 nt, Artificial Sequence
  CXCR4 targeting guide RNA
gcacgcuucggacggcgggaa

SEQ ID NO: 3772 - RNA, 21 nt, Artificial Sequence
  CXCR4 targeting guide RNA
gccguccgaagcgugccucuu

SEQ ID NO: 3773 - RNA, 21 nt, Artificial Sequence
  CXCR4 targeting guide RNA
gccguggggaagaggcacgcu

SEQ ID NO: 3774 - RNA, 21 nt, Artificial Sequence
  CXCR4 targeting guide RNA
gcggccguggggaagaggcac

SEQ ID NO: 3775 - RNA, 21 nt, Artificial Sequence
  CXCR4 targeting guide RNA
gcgugccucuuccccacggcc

SEQ ID NO: 3776 - RNA, 21 nt, Artificial Sequence
  CXCR4 targeting guide RNA
ggaagaggcacgcuucggacg

SEQ ID NO: 3777 - RNA, 21 nt, Artificial Sequence
  CXCR4 targeting guide RNA
ggcacgcuucggacggcggga

SEQ ID NO: 3778 - RNA, 21 nt, Artificial Sequence
  CXCR4 targeting guide RNA
ggccguggggaagaggcacgc

SEQ ID NO: 3779 - RNA, 21 nt, Artificial Sequence
  CXCR4 targeting guide RNA
gggaagaggcacgcuucggac

SEQ ID NO: 3780 - RNA, 21 nt, Artificial Sequence
  CXCR4 targeting guide RNA
ggggaagaggcacgcuucgga

SEQ ID NO: 3781 - RNA, 21 nt, Artificial Sequence
  CXCR4 targeting guide RNA
guccgaagcgugccucuuccc

SEQ ID NO: 3782 - RNA, 21 nt, Artificial Sequence
  CXCR4 targeting guide RNA
gugccucuuccccacggccgc

SEQ ID NO: 3783 - RNA, 21 nt, Artificial Sequence
  CXCR4 targeting guide RNA
guggggaagaggcacgcuucg

SEQ ID NO: 3784 - RNA, 21 nt, Artificial Sequence
  CXCR4 targeting guide RNA
ucccgccguccgaagcgugcc

SEQ ID NO: 3785 - RNA, 21 nt, Artificial Sequence
  CXCR4 targeting guide RNA
uccgaagcgugccucuucccc

SEQ ID NO: 3786 - RNA, 21 nt, Artificial Sequence
  CXCR4 targeting guide RNA
uggggaagaggcacgcuucgg

SEQ ID NO: 3787 - RNA, 21 nt, Artificial Sequence
  CXCR4 targeting guide RNA
uucccgccguccgaagcgugc

SEQ ID NO: 3788 - RNA, 22 nt, Artificial Sequence
  CXCR4 targeting guide RNA
aagaggcacgcuucggacggcg

SEQ ID NO: 3789 - RNA, 22 nt, Artificial Sequence
  CXCR4 targeting guide RNA
aagcgugccucuuccccacggc

SEQ ID NO: 3790 - RNA, 22 nt, Artificial Sequence
  CXCR4 targeting guide RNA
accuucccgccguccgaagcgu

SEQ ID NO: 3791 - RNA, 22 nt, Artificial Sequence
  CXCR4 targeting guide RNA
acgcuucggacggcgggaaggu

SEQ ID NO: 3792 - RNA, 22 nt, Artificial Sequence
  CXCR4 targeting guide RNA
agaggcacgcuucggacggcgg

SEQ ID NO: 3793 - RNA, 22 nt, Artificial Sequence
  CXCR4 targeting guide RNA
agcgugccucuuccccacggcc

SEQ ID NO: 3794 - RNA, 22 nt, Artificial Sequence
  CXCR4 targeting guide RNA
aggcacgcuucggacggcggga

SEQ ID NO: 3795 - RNA, 22 nt, Artificial Sequence
  CXCR4 targeting guide RNA
cacgcuucggacggcgggaagg

SEQ ID NO: 3796 - RNA, 22 nt, Artificial Sequence
  CXCR4 targeting guide RNA
cccgccguccgaagcgugccuc

SEQ ID NO: 3797 - RNA, 22 nt, Artificial Sequence
  CXCR4 targeting guide RNA
ccgaagcgugccucuuccccac

SEQ ID NO: 3798 - RNA, 22 nt, Artificial Sequence
  CXCR4 targeting guide RNA
ccgccguccgaagcgugccucu

SEQ ID NO: 3799 - RNA, 22 nt, Artificial Sequence
  CXCR4 targeting guide RNA
ccguccgaagcgugccucuucc

SEQ ID NO: 3800 - RNA, 22 nt, Artificial Sequence
  CXCR4 targeting guide RNA
ccguggggaagaggcacgcuuc

SEQ ID NO: 3801 - RNA, 22 nt, Artificial Sequence
  CXCR4 targeting guide RNA
ccuucccgccguccgaagcgug

SEQ ID NO: 3802 - RNA, 22 nt, Artificial Sequence
  CXCR4 targeting guide RNA
cgaagcgugccucuuccccacg

SEQ ID NO: 3803 - RNA, 22 nt, Artificial Sequence
  CXCR4 targeting guide RNA
cgccguccgaagcgugccucuu

SEQ ID NO: 3804 - RNA, 22 nt, Artificial Sequence
  CXCR4 targeting guide RNA
cgcggccguggggaagaggcac

SEQ ID NO: 3805 - RNA, 22 nt, Artificial Sequence
  CXCR4 targeting guide RNA
cggccguggggaagaggcacgc

SEQ ID NO: 3806 - RNA, 22 nt, Artificial Sequence
  CXCR4 targeting guide RNA
cguccgaagcgugccucuuccc

SEQ ID NO: 3807 - RNA, 22 nt, Artificial Sequence
  CXCR4 targeting guide RNA
cgugccucuuccccacggccgc

SEQ ID NO: 3808 - RNA, 22 nt, Artificial Sequence
  CXCR4 targeting guide RNA
cguggggaagaggcacgcuucg

SEQ ID NO: 3809 - RNA, 22 nt, Artificial Sequence
  CXCR4 targeting guide RNA
cuucccgccguccgaagcgugc

SEQ ID NO: 3810 - RNA, 22 nt, Artificial Sequence
  CXCR4 targeting guide RNA
gaagaggcacgcuucggacggc

SEQ ID NO: 3811 - RNA, 22 nt, Artificial Sequence
  CXCR4 targeting guide RNA
gaagcgugccucuuccccacgg

SEQ ID NO: 3812 - RNA, 22 nt, Artificial Sequence
  CXCR4 targeting guide RNA
gaggcacgcuucggacggcggg

SEQ ID NO: 3813 - RNA, 22 nt, Artificial Sequence
  CXCR4 targeting guide RNA
gcacgcuucggacggcgggaag

SEQ ID NO: 3814 - RNA, 22 nt, Artificial Sequence
  CXCR4 targeting guide RNA
gccguccgaagcgugccucuuc

SEQ ID NO: 3815 - RNA, 22 nt, Artificial Sequence
  CXCR4 targeting guide RNA
gccguggggaagaggcacgcuu

SEQ ID NO: 3816 - RNA, 22 nt, Artificial Sequence
  CXCR4 targeting guide RNA
gcggccguggggaagaggcacg

SEQ ID NO: 3817 - RNA, 22 nt, Artificial Sequence
  CXCR4 targeting guide RNA
gcgugccucuuccccacggccg

SEQ ID NO: 3818 - RNA, 22 nt, Artificial Sequence
  CXCR4 targeting guide RNA
ggaagaggcacgcuucggacgg

SEQ ID NO: 3819 - RNA, 22 nt, Artificial Sequence
  CXCR4 targeting guide RNA
ggcacgcuucggacggcgggaa

SEQ ID NO: 3820 - RNA, 22 nt, Artificial Sequence
  CXCR4 targeting guide RNA
ggccguggggaagaggcacgcu

SEQ ID NO: 3821 - RNA, 22 nt, Artificial Sequence
  CXCR4 targeting guide RNA
gggaagaggcacgcuucggacg

SEQ ID NO: 3822 - RNA, 22 nt, Artificial Sequence
  CXCR4 targeting guide RNA
ggggaagaggcacgcuucggac

SEQ ID NO: 3823 - RNA, 22 nt, Artificial Sequence
  CXCR4 targeting guide RNA
guccgaagcgugccucuucccc

SEQ ID NO: 3824 - RNA, 22 nt, Artificial Sequence
  CXCR4 targeting guide RNA
gugccucuuccccacggccgcg

SEQ ID NO: 3825 - RNA, 22 nt, Artificial Sequence
  CXCR4 targeting guide RNA
guggggaagaggcacgcuucgg

SEQ ID NO: 3826 - RNA, 22 nt, Artificial Sequence
  CXCR4 targeting guide RNA
ucccgccguccgaagcgugccu

SEQ ID NO: 3827 - RNA, 22 nt, Artificial Sequence
  CXCR4 targeting guide RNA
uccgaagcgugccucuucccca

SEQ ID NO: 3828 - RNA, 22 nt, Artificial Sequence
  CXCR4 targeting guide RNA
ucgcggccguggggaagaggca

SEQ ID NO: 3829 - RNA, 22 nt, Artificial Sequence
  CXCR4 targeting guide RNA
uggggaagaggcacgcuucgga

SEQ ID NO: 3830 - RNA, 22 nt, Artificial Sequence
  CXCR4 targeting guide RNA
uucccgccguccgaagcgugcc

SEQ ID NO: 3831 - RNA, 20 nt, Artificial Sequence
  CXCR4 targeting guide RNA
acccacccgcacuauauagg

SEQ ID NO: 3832 - RNA, 20 nt, Artificial Sequence
  CXCR4 targeting guide RNA
auagugcggguggguggggg

SEQ ID NO: 3833 - RNA, 20 nt, Artificial Sequence
  CXCR4 targeting guide RNA
auauagugcggguggguggg

SEQ ID NO: 3834 - RNA, 20 nt, Artificial Sequence
  CXCR4 targeting guide RNA
augccuauauagugcgggug

SEQ ID NO: 3835 - RNA, 20 nt, Artificial Sequence
  CXCR4 targeting guide RNA
auuccaauccugcucccccc

SEQ ID NO: 3836 - RNA, 20 nt, Artificial Sequence
  CXCR4 targeting guide RNA
cacccacccgcacuauauag

SEQ ID NO: 3837 - RNA, 20 nt, Artificial Sequence
  CXCR4 targeting guide RNA
caugccuauauagugcgggu

SEQ ID NO: 3838 - RNA, 20 nt, Artificial Sequence
  CXCR4 targeting guide RNA
ccacccacccgcacuauaua

SEQ ID NO: 3839 - RNA, 20 nt, Artificial Sequence
  CXCR4 targeting guide RNA
cccacccacccgcacuauau

SEQ ID NO: 3840 - RNA, 20 nt, Artificial Sequence
  CXCR4 targeting guide RNA
ccccacccacccgcacuaua

SEQ ID NO: 3841 - RNA, 20 nt, Artificial Sequence
  CXCR4 targeting guide RNA
cccccacccacccgcacuau

SEQ ID NO: 3842 - RNA, 20 nt, Artificial Sequence
  CXCR4 targeting guide RNA
ccccccacccacccgcacua

SEQ ID NO: 3843 - RNA, 20 nt, Artificial Sequence
  CXCR4 targeting guide RNA
ccuauauagugcgggugggu

SEQ ID NO: 3844 - RNA, 20 nt, Artificial Sequence
  CXCR4 targeting guide RNA
cuauauagugcgggugggug

SEQ ID NO: 3845 - RNA, 20 nt, Artificial Sequence
  CXCR4 targeting guide RNA
gccuauauagugcggguggg

SEQ ID NO: 3846 - RNA, 20 nt, Artificial Sequence
  CXCR4 targeting guide RNA
uagugcgggugggugggggg

SEQ ID NO: 3847 - RNA, 20 nt, Artificial Sequence
  CXCR4 targeting guide RNA
uauagugcgggugggugggg

SEQ ID NO: 3848 - RNA, 20 nt, Artificial Sequence
  CXCR4 targeting guide RNA
uauauagugcgggugggugg

SEQ ID NO: 3849 - RNA, 20 nt, Artificial Sequence
  CXCR4 targeting guide RNA
ugccuauauagugcgggugg

SEQ ID NO: 3850 - RNA, 21 nt, Artificial Sequence
  CXCR4 targeting guide RNA
acccacccgcacuauauaggc

SEQ ID NO: 3851 - RNA, 21 nt, Artificial Sequence
  CXCR4 targeting guide RNA
auagugcgggugggugggggg

SEQ ID NO: 3852 - RNA, 21 nt, Artificial Sequence
  CXCR4 targeting guide RNA
auauagugcgggugggugggg

SEQ ID NO: 3853 - RNA, 21 nt, Artificial Sequence
  CXCR4 targeting guide RNA
augccuauauagugcgggugg

SEQ ID NO: 3854 - RNA, 21 nt, Artificial Sequence
  CXCR4 targeting guide RNA
cacccacccgcacuauauagg

SEQ ID NO: 3855 - RNA, 21 nt, Artificial Sequence
  CXCR4 targeting guide RNA
caugccuauauagugcgggug

SEQ ID NO: 3856 - RNA, 21 nt, Artificial Sequence
  CXCR4 targeting guide RNA
ccacccacccgcacuauauag

SEQ ID NO: 3857 - RNA, 21 nt, Artificial Sequence
  CXCR4 targeting guide RNA
ccaugccuauauagugcgggu

SEQ ID NO: 3858 - RNA, 21 nt, Artificial Sequence
  CXCR4 targeting guide RNA
cccacccacccgcacuauaua

SEQ ID NO: 3859 - RNA, 21 nt, Artificial Sequence
  CXCR4 targeting guide RNA
ccccacccacccgcacuauau

SEQ ID NO: 3860 - RNA, 21 nt, Artificial Sequence
  CXCR4 targeting guide RNA
cccccacccacccgcacuaua

SEQ ID NO: 3861 - RNA, 21 nt, Artificial Sequence
  CXCR4 targeting guide RNA
ccccccacccacccgcacuau

SEQ ID NO: 3862 - RNA, 21 nt, Artificial Sequence
  CXCR4 targeting guide RNA
ccuauauagugcgggugggug

SEQ ID NO: 3863 - RNA, 21 nt, Artificial Sequence
  CXCR4 targeting guide RNA
cuauauagugcgggugggugg

SEQ ID NO: 3864 - RNA, 21 nt, Artificial Sequence
  CXCR4 targeting guide RNA
gauuccaauccugcucccccc

SEQ ID NO: 3865 - RNA, 21 nt, Artificial Sequence
  CXCR4 targeting guide RNA
gccuauauagugcgggugggu

SEQ ID NO: 3866 - RNA, 21 nt, Artificial Sequence
  CXCR4 targeting guide RNA
uauagugcggguggguggggg

SEQ ID NO: 3867 - RNA, 21 nt, Artificial Sequence
  CXCR4 targeting guide RNA
uauauagugcggguggguggg

SEQ ID NO: 3868 - RNA, 21 nt, Artificial Sequence
  CXCR4 targeting guide RNA
ugccuauauagugcggguggg

SEQ ID NO: 3869 - RNA, 22 nt, Artificial Sequence
  CXCR4 targeting guide RNA
accaugccuauauagugcgggu

SEQ ID NO: 3870 - RNA, 22 nt, Artificial Sequence
  CXCR4 targeting guide RNA
acccacccgcacuauauaggca

SEQ ID NO: 3871 - RNA, 22 nt, Artificial Sequence
  CXCR4 targeting guide RNA
agauuccaauccugcucccccc

SEQ ID NO: 3872 - RNA, 22 nt, Artificial Sequence
  CXCR4 targeting guide RNA
auauagugcggguggguggggg

SEQ ID NO: 3873 - RNA, 22 nt, Artificial Sequence
  CXCR4 targeting guide RNA
augccuauauagugcggguggg

SEQ ID NO: 3874 - RNA, 22 nt, Artificial Sequence
  CXCR4 targeting guide RNA
cacccacccgcacuauauaggc

SEQ ID NO: 3875 - RNA, 22 nt, Artificial Sequence
  CXCR4 targeting guide RNA
caugccuauauagugcgggugg

SEQ ID NO: 3876 - RNA, 22 nt, Artificial Sequence
  CXCR4 targeting guide RNA
ccacccacccgcacuauauagg

SEQ ID NO: 3877 - RNA, 22 nt, Artificial Sequence
  CXCR4 targeting guide RNA
ccaugccuauauagugcgggug

SEQ ID NO: 3878 - RNA, 22 nt, Artificial Sequence
  CXCR4 targeting guide RNA
cccacccacccgcacuauauag

SEQ ID NO: 3879 - RNA, 22 nt, Artificial Sequence
  CXCR4 targeting guide RNA
ccccacccacccgcacuauaua

SEQ ID NO: 3880 - RNA, 22 nt, Artificial Sequence
  CXCR4 targeting guide RNA
cccccacccacccgcacuauau

SEQ ID NO: 3881 - RNA, 22 nt, Artificial Sequence
  CXCR4 targeting guide RNA
ccccccacccacccgcacuaua

SEQ ID NO: 3882 - RNA, 22 nt, Artificial Sequence
  CXCR4 targeting guide RNA
ccuauauagugcgggugggugg

SEQ ID NO: 3883 - RNA, 22 nt, Artificial Sequence
  CXCR4 targeting guide RNA
cuauauagugcggguggguggg

SEQ ID NO: 3884 - RNA, 22 nt, Artificial Sequence
  CXCR4 targeting guide RNA
gccuauauagugcgggugggug

SEQ ID NO: 3885 - RNA, 22 nt, Artificial Sequence
  CXCR4 targeting guide RNA
uauagugcgggugggugggggg

SEQ ID NO: 3886 - RNA, 22 nt, Artificial Sequence
  CXCR4 targeting guide RNA
uauauagugcgggugggugggg

SEQ ID NO: 3887 - RNA, 22 nt, Artificial Sequence
  CXCR4 targeting guide RNA
ugccuauauagugcgggugggu

SEQ ID NO: 3888 - RNA, 20 nt, Artificial Sequence
  CXCR4 targeting guide RNA
ccccacccgcacuauauagg

SEQ ID NO: 3889 - RNA, 20 nt, Artificial Sequence
  CXCR4 targeting guide RNA
cccccacccgcacuauauag

SEQ ID NO: 3890 - RNA, 20 nt, Artificial Sequence
  CXCR4 targeting guide RNA
ccccccacccgcacuauaua

SEQ ID NO: 3891 - RNA, 20 nt, Artificial Sequence
  CXCR4 targeting guide RNA
ccuauauagugcgggugggg

SEQ ID NO: 3892 - RNA, 20 nt, Artificial Sequence
  CXCR4 targeting guide RNA
cuauauagugcggguggggg

SEQ ID NO: 3893 - RNA, 20 nt, Artificial Sequence
  CXCR4 targeting guide RNA
uauauagugcgggugggggg

SEQ ID NO: 3894 - RNA, 21 nt, Artificial Sequence
  CXCR4 targeting guide RNA
ccccacccgcacuauauaggc

SEQ ID NO: 3895 - RNA, 21 nt, Artificial Sequence
  CXCR4 targeting guide RNA
cccccacccgcacuauauagg

SEQ ID NO: 3896 - RNA, 21 nt, Artificial Sequence
  CXCR4 targeting guide RNA
ccccccacccgcacuauauag

SEQ ID NO: 3897 - RNA, 21 nt, Artificial Sequence
  CXCR4 targeting guide RNA
ccuauauagugcggguggggg

SEQ ID NO: 3898 - RNA, 21 nt, Artificial Sequence
  CXCR4 targeting guide RNA
cuauauagugcgggugggggg

SEQ ID NO: 3899 - RNA, 21 nt, Artificial Sequence
  CXCR4 targeting guide RNA
gccuauauagugcgggugggg

SEQ ID NO: 3900 - RNA, 22 nt, Artificial Sequence
  CXCR4 targeting guide RNA
ccccacccgcacuauauaggca

SEQ ID NO: 3901 - RNA, 22 nt, Artificial Sequence
  CXCR4 targeting guide RNA
cccccacccgcacuauauaggc

SEQ ID NO: 3902 - RNA, 22 nt, Artificial Sequence
  CXCR4 targeting guide RNA
ccccccacccgcacuauauagg

SEQ ID NO: 3903 - RNA, 22 nt, Artificial Sequence
  CXCR4 targeting guide RNA
ccuauauagugcgggugggggg

SEQ ID NO: 3904 - RNA, 22 nt, Artificial Sequence
  CXCR4 targeting guide RNA
gccuauauagugcggguggggg

SEQ ID NO: 3905 - RNA, 22 nt, Artificial Sequence
  CXCR4 targeting guide RNA
ugccuauauagugcgggugggg

SEQ ID NO: 3906 - RNA, 20 nt, Artificial Sequence
  CXCR4 targeting guide RNA
accaugccuauauagugcgg

SEQ ID NO: 3907 - RNA, 20 nt, Artificial Sequence
  CXCR4 targeting guide RNA
acccgcacuauauaggcaug

SEQ ID NO: 3908 - RNA, 20 nt, Artificial Sequence
  CXCR4 targeting guide RNA
cacccgcacuauauaggcau

SEQ ID NO: 3909 - RNA, 20 nt, Artificial Sequence
  CXCR4 targeting guide RNA
ccacccgcacuauauaggca

SEQ ID NO: 3910 - RNA, 20 nt, Artificial Sequence
  CXCR4 targeting guide RNA
ccaugccuauauagugcggg

SEQ ID NO: 3911 - RNA, 20 nt, Artificial Sequence
  CXCR4 targeting guide RNA
cccacccgcacuauauaggc

SEQ ID NO: 3912 - RNA, 20 nt, Artificial Sequence
  CXCR4 targeting guide RNA
gaccaugccuauauagugcg

SEQ ID NO: 3913 - RNA, 20 nt, Artificial Sequence
  CXCR4 targeting guide RNA
ugaccaugccuauauagugc

SEQ ID NO: 3914 - RNA, 21 nt, Artificial Sequence
  CXCR4 targeting guide RNA
accaugccuauauagugcggg

SEQ ID NO: 3915 - RNA, 21 nt, Artificial Sequence
  CXCR4 targeting guide RNA
acccgcacuauauaggcaugg

SEQ ID NO: 3916 - RNA, 21 nt, Artificial Sequence
  CXCR4 targeting guide RNA
cacccgcacuauauaggcaug

SEQ ID NO: 3917 - RNA, 21 nt, Artificial Sequence
  CXCR4 targeting guide RNA
ccacccgcacuauauaggcau

SEQ ID NO: 3918 - RNA, 21 nt, Artificial Sequence
  CXCR4 targeting guide RNA
cccacccgcacuauauaggca

SEQ ID NO: 3919 - RNA, 21 nt, Artificial Sequence
  CXCR4 targeting guide RNA
gaccaugccuauauagugcgg

SEQ ID NO: 3920 - RNA, 21 nt, Artificial Sequence
  CXCR4 targeting guide RNA
ugaccaugccuauauagugcg

SEQ ID NO: 3921 - RNA, 21 nt, Artificial Sequence
  CXCR4 targeting guide RNA
uugaccaugccuauauagugc

SEQ ID NO: 3922 - RNA, 22 nt, Artificial Sequence
  CXCR4 targeting guide RNA
acccgcacuauauaggcauggu

SEQ ID NO: 3923 - RNA, 22 nt, Artificial Sequence
  CXCR4 targeting guide RNA
cacccgcacuauauaggcaugg

SEQ ID NO: 3924 - RNA, 22 nt, Artificial Sequence
  CXCR4 targeting guide RNA
ccacccgcacuauauaggcaug

SEQ ID NO: 3925 - RNA, 22 nt, Artificial Sequence
  CXCR4 targeting guide RNA
cccacccgcacuauauaggcau

SEQ ID NO: 3926 - RNA, 22 nt, Artificial Sequence
  CXCR4 targeting guide RNA
cuugaccaugccuauauagugc

SEQ ID NO: 3927 - RNA, 22 nt, Artificial Sequence
  CXCR4 targeting guide RNA
gaccaugccuauauagugcggg

SEQ ID NO: 3928 - RNA, 22 nt, Artificial Sequence
  CXCR4 targeting guide RNA
ugaccaugccuauauagugcgg

SEQ ID NO: 3929 - RNA, 22 nt, Artificial Sequence
  CXCR4 targeting guide RNA
uugaccaugccuauauagugcg

SEQ ID NO: 3930 - RNA, 20 nt, Artificial Sequence
  CXCR4 targeting guide RNA
augccuauauagugcggggg

SEQ ID NO: 3931 - RNA, 20 nt, Artificial Sequence
  CXCR4 targeting guide RNA
caugccuauauagugcgggg

SEQ ID NO: 3932 - RNA, 20 nt, Artificial Sequence
  CXCR4 targeting guide RNA
ccccccgcacuauauaggca

SEQ ID NO: 3933 - RNA, 20 nt, Artificial Sequence
  CXCR4 targeting guide RNA
cccccgcacuauauaggcau

SEQ ID NO: 3934 - RNA, 20 nt, Artificial Sequence
  CXCR4 targeting guide RNA
ccccgcacuauauaggcaug

SEQ ID NO: 3935 - RNA, 20 nt, Artificial Sequence
  CXCR4 targeting guide RNA
ugccuauauagugcgggggg

SEQ ID NO: 3936 - RNA, 21 nt, Artificial Sequence
  CXCR4 targeting guide RNA
augccuauauagugcgggggg

SEQ ID NO: 3937 - RNA, 21 nt, Artificial Sequence
  CXCR4 targeting guide RNA
caugccuauauagugcggggg

SEQ ID NO: 3938 - RNA, 21 nt, Artificial Sequence
  CXCR4 targeting guide RNA
ccaugccuauauagugcgggg

SEQ ID NO: 3939 - RNA, 21 nt, Artificial Sequence
  CXCR4 targeting guide RNA
ccccccgcacuauauaggcau

SEQ ID NO: 3940 - RNA, 21 nt, Artificial Sequence
  CXCR4 targeting guide RNA
cccccgcacuauauaggcaug

SEQ ID NO: 3941 - RNA, 21 nt, Artificial Sequence
  CXCR4 targeting guide RNA
ccccgcacuauauaggcaugg

SEQ ID NO: 3942 - RNA, 22 nt, Artificial Sequence
  CXCR4 targeting guide RNA
accaugccuauauagugcgggg

SEQ ID NO: 3943 - RNA, 22 nt, Artificial Sequence
  CXCR4 targeting guide RNA
caugccuauauagugcgggggg

SEQ ID NO: 3944 - RNA, 22 nt, Artificial Sequence
  CXCR4 targeting guide RNA
ccaugccuauauagugcggggg

SEQ ID NO: 3945 - RNA, 22 nt, Artificial Sequence
  CXCR4 targeting guide RNA
ccccccgcacuauauaggcaug

SEQ ID NO: 3946 - RNA, 22 nt, Artificial Sequence
  CXCR4 targeting guide RNA
cccccgcacuauauaggcaugg

SEQ ID NO: 3947 - RNA, 22 nt, Artificial Sequence
  CXCR4 targeting guide RNA
ccccgcacuauauaggcauggu

SEQ ID NO: 3948 - RNA, 20 nt, Artificial Sequence
  CXCR4 targeting guide RNA
cccgcacuauauaggcaugg

SEQ ID NO: 3949 - RNA, 20 nt, Artificial Sequence
  CXCR4 targeting guide RNA
ccgcacuauauaggcauggu

SEQ ID NO: 3950 - RNA, 20 nt, Artificial Sequence
  CXCR4 targeting guide RNA
cgcacuauauaggcaugguc

SEQ ID NO: 3951 - RNA, 20 nt, Artificial Sequence
  CXCR4 targeting guide RNA
cuugaccaugccuauauagu

SEQ ID NO: 3952 - RNA, 20 nt, Artificial Sequence
  CXCR4 targeting guide RNA
gcacuauauaggcaugguca

SEQ ID NO: 3953 - RNA, 20 nt, Artificial Sequence
  CXCR4 targeting guide RNA
ucuugaccaugccuauauag

SEQ ID NO: 3954 - RNA, 20 nt, Artificial Sequence
  CXCR4 targeting guide RNA
uucuugaccaugccuauaua

SEQ ID NO: 3955 - RNA, 20 nt, Artificial Sequence
  CXCR4 targeting guide RNA
uugaccaugccuauauagug

SEQ ID NO: 3956 - RNA, 21 nt, Artificial Sequence
  CXCR4 targeting guide RNA
cccgcacuauauaggcauggu

SEQ ID NO: 3957 - RNA, 21 nt, Artificial Sequence
  CXCR4 targeting guide RNA
ccgcacuauauaggcaugguc

SEQ ID NO: 3958 - RNA, 21 nt, Artificial Sequence
  CXCR4 targeting guide RNA
cgcacuauauaggcaugguca

SEQ ID NO: 3959 - RNA, 21 nt, Artificial Sequence
  CXCR4 targeting guide RNA
cuugaccaugccuauauagug

SEQ ID NO: 3960 - RNA, 21 nt, Artificial Sequence
  CXCR4 targeting guide RNA
gcacuauauaggcauggucaa

SEQ ID NO: 3961 - RNA, 21 nt, Artificial Sequence
  CXCR4 targeting guide RNA
ucuugaccaugccuauauagu

SEQ ID NO: 3962 - RNA, 21 nt, Artificial Sequence
  CXCR4 targeting guide RNA
uucuugaccaugccuauauag

SEQ ID NO: 3963 - RNA, 21 nt, Artificial Sequence
  CXCR4 targeting guide RNA
uuucuugaccaugccuauaua

SEQ ID NO: 3964 - RNA, 22 nt, Artificial Sequence
  CXCR4 targeting guide RNA
cccgcacuauauaggcaugguc

SEQ ID NO: 3965 - RNA, 22 nt, Artificial Sequence
  CXCR4 targeting guide RNA
ccgcacuauauaggcaugguca

SEQ ID NO: 3966 - RNA, 22 nt, Artificial Sequence
  CXCR4 targeting guide RNA
cgcacuauauaggcauggucaa

SEQ ID NO: 3967 - RNA, 22 nt, Artificial Sequence
  CXCR4 targeting guide RNA
gcacuauauaggcauggucaag

SEQ ID NO: 3968 - RNA, 22 nt, Artificial Sequence
  CXCR4 targeting guide RNA
ucuugaccaugccuauauagug

SEQ ID NO: 3969 - RNA, 22 nt, Artificial Sequence
  CXCR4 targeting guide RNA
uucuugaccaugccuauauagu

SEQ ID NO: 3970 - RNA, 22 nt, Artificial Sequence
  CXCR4 targeting guide RNA
uuucuugaccaugccuauauag

SEQ ID NO: 3971 - RNA, 22 nt, Artificial Sequence
  CXCR4 targeting guide RNA
uuuucuugaccaugccuauaua

SEQ ID NO: 3972 - RNA, 20 nt, Artificial Sequence
  CXCR4 targeting guide RNA
accaugccuauauagugggg

SEQ ID NO: 3973 - RNA, 20 nt, Artificial Sequence
  CXCR4 targeting guide RNA
acccacccccacuauauagg

SEQ ID NO: 3974 - RNA, 20 nt, Artificial Sequence
  CXCR4 targeting guide RNA
acccccacuauauaggcaug

SEQ ID NO: 3975 - RNA, 20 nt, Artificial Sequence
  CXCR4 targeting guide RNA
auaguggggguggguggggg

SEQ ID NO: 3976 - RNA, 20 nt, Artificial Sequence
  CXCR4 targeting guide RNA
auauaguggggguggguggg

SEQ ID NO: 3977 - RNA, 20 nt, Artificial Sequence
  CXCR4 targeting guide RNA
augccuauauagugggggug

SEQ ID NO: 3978 - RNA, 20 nt, Artificial Sequence
  CXCR4 targeting guide RNA
cacccacccccacuauauag

SEQ ID NO: 3979 - RNA, 20 nt, Artificial Sequence
  CXCR4 targeting guide RNA
cacccccacuauauaggcau

SEQ ID NO: 3980 - RNA, 20 nt, Artificial Sequence
  CXCR4 targeting guide RNA
caugccuauauagugggggu

SEQ ID NO: 3981 - RNA, 20 nt, Artificial Sequence
  CXCR4 targeting guide RNA
ccacccacccccacuauaua

SEQ ID NO: 3982 - RNA, 20 nt, Artificial Sequence
  CXCR4 targeting guide RNA
ccacccccacuauauaggca

SEQ ID NO: 3983 - RNA, 20 nt, Artificial Sequence
  CXCR4 targeting guide RNA
ccacuauauaggcaugguca

SEQ ID NO: 3984 - RNA, 20 nt, Artificial Sequence
  CXCR4 targeting guide RNA
ccaugccuauauaguggggg

SEQ ID NO: 3985 - RNA, 20 nt, Artificial Sequence
  CXCR4 targeting guide RNA
cccacccacccccacuauau

SEQ ID NO: 3986 - RNA, 20 nt, Artificial Sequence
  CXCR4 targeting guide RNA
cccacccccacuauauaggc

SEQ ID NO: 3987 - RNA, 20 nt, Artificial Sequence
  CXCR4 targeting guide RNA
cccacuauauaggcaugguc

SEQ ID NO: 3988 - RNA, 20 nt, Artificial Sequence
  CXCR4 targeting guide RNA
ccccacccacccccacuaua

SEQ ID NO: 3989 - RNA, 20 nt, Artificial Sequence
  CXCR4 targeting guide RNA
ccccacuauauaggcauggu

SEQ ID NO: 3990 - RNA, 20 nt, Artificial Sequence
  CXCR4 targeting guide RNA
cccccacccacccccacuau

SEQ ID NO: 3991 - RNA, 20 nt, Artificial Sequence
  CXCR4 targeting guide RNA
cccccacuauauaggcaugg

SEQ ID NO: 3992 - RNA, 20 nt, Artificial Sequence
  CXCR4 targeting guide RNA
ccccccacccacccccacua

SEQ ID NO: 3993 - RNA, 20 nt, Artificial Sequence
  CXCR4 targeting guide RNA
ccuauauagugggggugggu

SEQ ID NO: 3994 - RNA, 20 nt, Artificial Sequence
  CXCR4 targeting guide RNA
cuauauagugggggugggug

SEQ ID NO: 3995 - RNA, 20 nt, Artificial Sequence
  CXCR4 targeting guide RNA
gaccaugccuauauaguggg

SEQ ID NO: 3996 - RNA, 20 nt, Artificial Sequence
  CXCR4 targeting guide RNA
gccuauauaguggggguggg

SEQ ID NO: 3997 - RNA, 20 nt, Artificial Sequence
  CXCR4 targeting guide RNA
uagugggggugggugggggg

SEQ ID NO: 3998 - RNA, 20 nt, Artificial Sequence
  CXCR4 targeting guide RNA
uauagugggggugggugggg

SEQ ID NO: 3999 - RNA, 20 nt, Artificial Sequence
  CXCR4 targeting guide RNA
uauauagugggggugggugg

SEQ ID NO: 4000 - RNA, 20 nt, Artificial Sequence
  CXCR4 targeting guide RNA
ugaccaugccuauauagugg

SEQ ID NO: 4001 - RNA, 20 nt, Artificial Sequence
  CXCR4 targeting guide RNA
ugccuauauagugggggugg

SEQ ID NO: 4002 - RNA, 21 nt, Artificial Sequence
  CXCR4 targeting guide RNA
accaugccuauauaguggggg

SEQ ID NO: 4003 - RNA, 21 nt, Artificial Sequence
  CXCR4 targeting guide RNA
acccacccccacuauauaggc

SEQ ID NO: 4004 - RNA, 21 nt, Artificial Sequence
  CXCR4 targeting guide RNA
acccccacuauauaggcaugg

SEQ ID NO: 4005 - RNA, 21 nt, Artificial Sequence
  CXCR4 targeting guide RNA
auagugggggugggugggggg

SEQ ID NO: 4006 - RNA, 21 nt, Artificial Sequence
  CXCR4 targeting guide RNA
auauagugggggugggugggg

SEQ ID NO: 4007 - RNA, 21 nt, Artificial Sequence
  CXCR4 targeting guide RNA
augccuauauagugggggugg

SEQ ID NO: 4008 - RNA, 21 nt, Artificial Sequence
  CXCR4 targeting guide RNA
cacccacccccacuauauagg

SEQ ID NO: 4009 - RNA, 21 nt, Artificial Sequence
  CXCR4 targeting guide RNA
cacccccacuauauaggcaug

SEQ ID NO: 4010 - RNA, 21 nt, Artificial Sequence
  CXCR4 targeting guide RNA
caugccuauauagugggggug

SEQ ID NO: 4011 - RNA, 21 nt, Artificial Sequence
  CXCR4 targeting guide RNA
ccacccacccccacuauauag

SEQ ID NO: 4012 - RNA, 21 nt, Artificial Sequence
  CXCR4 targeting guide RNA
ccacccccacuauauaggcau

SEQ ID NO: 4013 - RNA, 21 nt, Artificial Sequence
  CXCR4 targeting guide RNA
ccacuauauaggcauggucaa

SEQ ID NO: 4014 - RNA, 21 nt, Artificial Sequence
  CXCR4 targeting guide RNA
ccaugccuauauagugggggu

SEQ ID NO: 4015 - RNA, 21 nt, Artificial Sequence
  CXCR4 targeting guide RNA
cccacccacccccacuauaua

SEQ ID NO: 4016 - RNA, 21 nt, Artificial Sequence
  CXCR4 targeting guide RNA
cccacccccacuauauaggca

SEQ ID NO: 4017 - RNA, 21 nt, Artificial Sequence
  CXCR4 targeting guide RNA
cccacuauauaggcaugguca

SEQ ID NO: 4018 - RNA, 21 nt, Artificial Sequence
  CXCR4 targeting guide RNA
ccccacccacccccacuauau

SEQ ID NO: 4019 - RNA, 21 nt, Artificial Sequence
  CXCR4 targeting guide RNA
ccccacuauauaggcaugguc

SEQ ID NO: 4020 - RNA, 21 nt, Artificial Sequence
  CXCR4 targeting guide RNA
cccccacccacccccacuaua

SEQ ID NO: 4021 - RNA, 21 nt, Artificial Sequence
  CXCR4 targeting guide RNA
cccccacuauauaggcauggu

SEQ ID NO: 4022 - RNA, 21 nt, Artificial Sequence
  CXCR4 targeting guide RNA
ccccccacccacccccacuau

SEQ ID NO: 4023 - RNA, 21 nt, Artificial Sequence
  CXCR4 targeting guide RNA
ccuauauagugggggugggug

SEQ ID NO: 4024 - RNA, 21 nt, Artificial Sequence
  CXCR4 targeting guide RNA
cuauauagugggggugggugg

SEQ ID NO: 4025 - RNA, 21 nt, Artificial Sequence
  CXCR4 targeting guide RNA
gaccaugccuauauagugggg

SEQ ID NO: 4026 - RNA, 21 nt, Artificial Sequence
  CXCR4 targeting guide RNA
gccuauauagugggggugggu

SEQ ID NO: 4027 - RNA, 21 nt, Artificial Sequence
  CXCR4 targeting guide RNA
uauaguggggguggguggggg

SEQ ID NO: 4028 - RNA, 21 nt, Artificial Sequence
  CXCR4 targeting guide RNA
uauauaguggggguggguggg

SEQ ID NO: 4029 - RNA, 21 nt, Artificial Sequence
  CXCR4 targeting guide RNA
ugaccaugccuauauaguggg

SEQ ID NO: 4030 - RNA, 21 nt, Artificial Sequence
  CXCR4 targeting guide RNA
ugccuauauaguggggguggg

SEQ ID NO: 4031 - RNA, 21 nt, Artificial Sequence
  CXCR4 targeting guide RNA
uugaccaugccuauauagugg

SEQ ID NO: 4032 - RNA, 22 nt, Artificial Sequence
  CXCR4 targeting guide RNA
accaugccuauauagugggggu

SEQ ID NO: 4033 - RNA, 22 nt, Artificial Sequence
  CXCR4 targeting guide RNA
acccacccccacuauauaggca

SEQ ID NO: 4034 - RNA, 22 nt, Artificial Sequence
  CXCR4 targeting guide RNA
acccccacuauauaggcauggu

SEQ ID NO: 4035 - RNA, 22 nt, Artificial Sequence
  CXCR4 targeting guide RNA
auauaguggggguggguggggg

SEQ ID NO: 4036 - RNA, 22 nt, Artificial Sequence
  CXCR4 targeting guide RNA
augccuauauaguggggguggg

SEQ ID NO: 4037 - RNA, 22 nt, Artificial Sequence
  CXCR4 targeting guide RNA
cacccacccccacuauauaggc

SEQ ID NO: 4038 - RNA, 22 nt, Artificial Sequence
  CXCR4 targeting guide RNA
cacccccacuauauaggcaugg

SEQ ID NO: 4039 - RNA, 22 nt, Artificial Sequence
  CXCR4 targeting guide RNA
caugccuauauagugggggugg

SEQ ID NO: 4040 - RNA, 22 nt, Artificial Sequence
  CXCR4 targeting guide RNA
ccacccacccccacuauauagg

SEQ ID NO: 4041 - RNA, 22 nt, Artificial Sequence
  CXCR4 targeting guide RNA
ccacccccacuauauaggcaug

SEQ ID NO: 4042 - RNA, 22 nt, Artificial Sequence
  CXCR4 targeting guide RNA
ccacuauauaggcauggucaag

SEQ ID NO: 4043 - RNA, 22 nt, Artificial Sequence
  CXCR4 targeting guide RNA
ccaugccuauauagugggggug

SEQ ID NO: 4044 - RNA, 22 nt, Artificial Sequence
  CXCR4 targeting guide RNA
cccacccacccccacuauauag

SEQ ID NO: 4045 - RNA, 22 nt, Artificial Sequence
  CXCR4 targeting guide RNA
cccacccccacuauauaggcau

SEQ ID NO: 4046 - RNA, 22 nt, Artificial Sequence
  CXCR4 targeting guide RNA
cccacuauauaggcauggucaa

SEQ ID NO: 4047 - RNA, 22 nt, Artificial Sequence
  CXCR4 targeting guide RNA
ccccacccacccccacuauaua

SEQ ID NO: 4048 - RNA, 22 nt, Artificial Sequence
  CXCR4 targeting guide RNA
ccccacuauauaggcaugguca

SEQ ID NO: 4049 - RNA, 22 nt, Artificial Sequence
  CXCR4 targeting guide RNA
cccccacccacccccacuauau

SEQ ID NO: 4050 - RNA, 22 nt, Artificial Sequence
  CXCR4 targeting guide RNA
cccccacuauauaggcaugguc

SEQ ID NO: 4051 - RNA, 22 nt, Artificial Sequence
  CXCR4 targeting guide RNA
ccccccacccacccccacuaua

SEQ ID NO: 4052 - RNA, 22 nt, Artificial Sequence
  CXCR4 targeting guide RNA
ccuauauagugggggugggugg

SEQ ID NO: 4053 - RNA, 22 nt, Artificial Sequence
  CXCR4 targeting guide RNA
cuauauaguggggguggguggg

SEQ ID NO: 4054 - RNA, 22 nt, Artificial Sequence
  CXCR4 targeting guide RNA
cuugaccaugccuauauagugg

SEQ ID NO: 4055 - RNA, 22 nt, Artificial Sequence
  CXCR4 targeting guide RNA
gaccaugccuauauaguggggg

SEQ ID NO: 4056 - RNA, 22 nt, Artificial Sequence
  CXCR4 targeting guide RNA
gccuauauagugggggugggug

SEQ ID NO: 4057 - RNA, 22 nt, Artificial Sequence
  CXCR4 targeting guide RNA
uauagugggggugggugggggg

SEQ ID NO: 4058 - RNA, 22 nt, Artificial Sequence
  CXCR4 targeting guide RNA
uauauagugggggugggugggg

SEQ ID NO: 4059 - RNA, 22 nt, Artificial Sequence
  CXCR4 targeting guide RNA
ugaccaugccuauauagugggg

SEQ ID NO: 4060 - RNA, 22 nt, Artificial Sequence
  CXCR4 targeting guide RNA
ugccuauauagugggggugggu

SEQ ID NO: 4061 - RNA, 22 nt, Artificial Sequence
  CXCR4 targeting guide RNA
uugaccaugccuauauaguggg

SEQ ID NO: 4062 - RNA, 20 nt, Artificial Sequence
  CXCR4 targeting guide RNA
acuauauaggcauggucaag

SEQ ID NO: 4063 - RNA, 20 nt, Artificial Sequence
  CXCR4 targeting guide RNA
cacuauauaggcauggucaa

SEQ ID NO: 4064 - RNA, 20 nt, Artificial Sequence
  CXCR4 targeting guide RNA
uuucuugaccaugccuauau

SEQ ID NO: 4065 - RNA, 20 nt, Artificial Sequence
  CXCR4 targeting guide RNA
uuuucuugaccaugccuaua

SEQ ID NO: 4066 - RNA, 21 nt, Artificial Sequence
  CXCR4 targeting guide RNA
acuauauaggcauggucaaga

SEQ ID NO: 4067 - RNA, 21 nt, Artificial Sequence
  CXCR4 targeting guide RNA
cacuauauaggcauggucaag

SEQ ID NO: 4068 - RNA, 21 nt, Artificial Sequence
  CXCR4 targeting guide RNA
guuuucuugaccaugccuaua

SEQ ID NO: 4069 - RNA, 21 nt, Artificial Sequence
  CXCR4 targeting guide RNA
uuuucuugaccaugccuauau

SEQ ID NO: 4070 - RNA, 22 nt, Artificial Sequence
  CXCR4 targeting guide RNA
acuauauaggcauggucaagaa

SEQ ID NO: 4071 - RNA, 22 nt, Artificial Sequence
  CXCR4 targeting guide RNA
aguuuucuugaccaugccuaua

SEQ ID NO: 4072 - RNA, 22 nt, Artificial Sequence
  CXCR4 targeting guide RNA
cacuauauaggcauggucaaga

SEQ ID NO: 4073 - RNA, 22 nt, Artificial Sequence
  CXCR4 targeting guide RNA
guuuucuugaccaugccuauau

SEQ ID NO: 4074 - RNA, 20 nt, Artificial Sequence
  CXCR4 targeting guide RNA
accaugccuauauagggcgg

SEQ ID NO: 4075 - RNA, 20 nt, Artificial Sequence
  CXCR4 targeting guide RNA
acccacccgcccuauauagg

SEQ ID NO: 4076 - RNA, 20 nt, Artificial Sequence
  CXCR4 targeting guide RNA
acccgcccuauauaggcaug

SEQ ID NO: 4077 - RNA, 20 nt, Artificial Sequence
  CXCR4 targeting guide RNA
auagggcggguggguggggg

SEQ ID NO: 4078 - RNA, 20 nt, Artificial Sequence
  CXCR4 targeting guide RNA
auauagggcggguggguggg

SEQ ID NO: 4079 - RNA, 20 nt, Artificial Sequence
  CXCR4 targeting guide RNA
augccuauauagggcgggug

SEQ ID NO: 4080 - RNA, 20 nt, Artificial Sequence
  CXCR4 targeting guide RNA
cacccacccgcccuauauag

SEQ ID NO: 4081 - RNA, 20 nt, Artificial Sequence
  CXCR4 targeting guide RNA
cacccgcccuauauaggcau

SEQ ID NO: 4082 - RNA, 20 nt, Artificial Sequence
  CXCR4 targeting guide RNA
caugccuauauagggcgggu

SEQ ID NO: 4083 - RNA, 20 nt, Artificial Sequence
  CXCR4 targeting guide RNA
ccacccacccgcccuauaua

SEQ ID NO: 4084 - RNA, 20 nt, Artificial Sequence
  CXCR4 targeting guide RNA
ccacccgcccuauauaggca

SEQ ID NO: 4085 - RNA, 20 nt, Artificial Sequence
  CXCR4 targeting guide RNA
ccaugccuauauagggcggg

SEQ ID NO: 4086 - RNA, 20 nt, Artificial Sequence
  CXCR4 targeting guide RNA
cccacccacccgcccuauau

SEQ ID NO: 4087 - RNA, 20 nt, Artificial Sequence
  CXCR4 targeting guide RNA
cccacccgcccuauauaggc

SEQ ID NO: 4088 - RNA, 20 nt, Artificial Sequence
  CXCR4 targeting guide RNA
ccccacccacccgcccuaua

SEQ ID NO: 4089 - RNA, 20 nt, Artificial Sequence
  CXCR4 targeting guide RNA
cccccacccacccgcccuau

SEQ ID NO: 4090 - RNA, 20 nt, Artificial Sequence
  CXCR4 targeting guide RNA
ccccccacccacccgcccua

SEQ ID NO: 4091 - RNA, 20 nt, Artificial Sequence
  CXCR4 targeting guide RNA
cccgcccuauauaggcaugg

SEQ ID NO: 4092 - RNA, 20 nt, Artificial Sequence
  CXCR4 targeting guide RNA
cccuauauaggcauggucaa

SEQ ID NO: 4093 - RNA, 20 nt, Artificial Sequence
  CXCR4 targeting guide RNA
ccgcccuauauaggcauggu

SEQ ID NO: 4094 - RNA, 20 nt, Artificial Sequence
  CXCR4 targeting guide RNA
ccuauauaggcauggucaag

SEQ ID NO: 4095 - RNA, 20 nt, Artificial Sequence
  CXCR4 targeting guide RNA
ccuauauagggcgggugggu

SEQ ID NO: 4096 - RNA, 20 nt, Artificial Sequence
  CXCR4 targeting guide RNA
cgcccuauauaggcaugguc

SEQ ID NO: 4097 - RNA, 20 nt, Artificial Sequence
  CXCR4 targeting guide RNA
cuauauagggcgggugggug

SEQ ID NO: 4098 - RNA, 20 nt, Artificial Sequence
  CXCR4 targeting guide RNA
cuugaccaugccuauauagg

SEQ ID NO: 4099 - RNA, 20 nt, Artificial Sequence
  CXCR4 targeting guide RNA
gaccaugccuauauagggcg

SEQ ID NO: 4100 - RNA, 20 nt, Artificial Sequence
  CXCR4 targeting guide RNA
gcccuauauaggcaugguca

SEQ ID NO: 4101 - RNA, 20 nt, Artificial Sequence
  CXCR4 targeting guide RNA
gccuauauagggcggguggg

SEQ ID NO: 4102 - RNA, 20 nt, Artificial Sequence
  CXCR4 targeting guide RNA
uagggcgggugggugggggg

SEQ ID NO: 4103 - RNA, 20 nt, Artificial Sequence
  CXCR4 targeting guide RNA
uauagggcgggugggugggg

SEQ ID NO: 4104 - RNA, 20 nt, Artificial Sequence
  CXCR4 targeting guide RNA
uauauagggcgggugggugg

SEQ ID NO: 4105 - RNA, 20 nt, Artificial Sequence
  CXCR4 targeting guide RNA
ugaccaugccuauauagggc

SEQ ID NO: 4106 - RNA, 20 nt, Artificial Sequence
  CXCR4 targeting guide RNA
ugccuauauagggcgggugg

SEQ ID NO: 4107 - RNA, 20 nt, Artificial Sequence
  CXCR4 targeting guide RNA
uugaccaugccuauauaggg

SEQ ID NO: 4108 - RNA, 21 nt, Artificial Sequence
  CXCR4 targeting guide RNA
accaugccuauauagggcggg

SEQ ID NO: 4109 - RNA, 21 nt, Artificial Sequence
  CXCR4 targeting guide RNA
acccacccgcccuauauaggc

SEQ ID NO: 4110 - RNA, 21 nt, Artificial Sequence
  CXCR4 targeting guide RNA
acccgcccuauauaggcaugg

SEQ ID NO: 4111 - RNA, 21 nt, Artificial Sequence
  CXCR4 targeting guide RNA
auagggcgggugggugggggg

SEQ ID NO: 4112 - RNA, 21 nt, Artificial Sequence
  CXCR4 targeting guide RNA
auauagggcgggugggugggg

SEQ ID NO: 4113 - RNA, 21 nt, Artificial Sequence
  CXCR4 targeting guide RNA
augccuauauagggcgggugg

SEQ ID NO: 4114 - RNA, 21 nt, Artificial Sequence
  CXCR4 targeting guide RNA
cacccacccgcccuauauagg

SEQ ID NO: 4115 - RNA, 21 nt, Artificial Sequence
  CXCR4 targeting guide RNA
cacccgcccuauauaggcaug

SEQ ID NO: 4116 - RNA, 21 nt, Artificial Sequence
  CXCR4 targeting guide RNA
caugccuauauagggcgggug

SEQ ID NO: 4117 - RNA, 21 nt, Artificial Sequence
  CXCR4 targeting guide RNA
ccacccacccgcccuauauag

SEQ ID NO: 4118 - RNA, 21 nt, Artificial Sequence
  CXCR4 targeting guide RNA
ccacccgcccuauauaggcau

SEQ ID NO: 4119 - RNA, 21 nt, Artificial Sequence
  CXCR4 targeting guide RNA
ccaugccuauauagggcgggu

SEQ ID NO: 4120 - RNA, 21 nt, Artificial Sequence
  CXCR4 targeting guide RNA
cccacccacccgcccuauaua

SEQ ID NO: 4121 - RNA, 21 nt, Artificial Sequence
  CXCR4 targeting guide RNA
cccacccgcccuauauaggca

SEQ ID NO: 4122 - RNA, 21 nt, Artificial Sequence
  CXCR4 targeting guide RNA
ccccacccacccgcccuauau

SEQ ID NO: 4123 - RNA, 21 nt, Artificial Sequence
  CXCR4 targeting guide RNA
cccccacccacccgcccuaua

SEQ ID NO: 4124 - RNA, 21 nt, Artificial Sequence
  CXCR4 targeting guide RNA
ccccccacccacccgcccuau

SEQ ID NO: 4125 - RNA, 21 nt, Artificial Sequence
  CXCR4 targeting guide RNA
cccgcccuauauaggcauggu

SEQ ID NO: 4126 - RNA, 21 nt, Artificial Sequence
  CXCR4 targeting guide RNA
cccuauauaggcauggucaag

SEQ ID NO: 4127 - RNA, 21 nt, Artificial Sequence
  CXCR4 targeting guide RNA
ccgcccuauauaggcaugguc

SEQ ID NO: 4128 - RNA, 21 nt, Artificial Sequence
  CXCR4 targeting guide RNA
ccuauauaggcauggucaaga

SEQ ID NO: 4129 - RNA, 21 nt, Artificial Sequence
  CXCR4 targeting guide RNA
ccuauauagggcgggugggug

SEQ ID NO: 4130 - RNA, 21 nt, Artificial Sequence
  CXCR4 targeting guide RNA
cgcccuauauaggcaugguca

SEQ ID NO: 4131 - RNA, 21 nt, Artificial Sequence
  CXCR4 targeting guide RNA
cuauauagggcgggugggugg

SEQ ID NO: 4132 - RNA, 21 nt, Artificial Sequence
  CXCR4 targeting guide RNA
cuugaccaugccuauauaggg

SEQ ID NO: 4133 - RNA, 21 nt, Artificial Sequence
  CXCR4 targeting guide RNA
gaccaugccuauauagggcgg

SEQ ID NO: 4134 - RNA, 21 nt, Artificial Sequence
  CXCR4 targeting guide RNA
gcccuauauaggcauggucaa

SEQ ID NO: 4135 - RNA, 21 nt, Artificial Sequence
  CXCR4 targeting guide RNA
gccuauauagggcgggugggu

SEQ ID NO: 4136 - RNA, 21 nt, Artificial Sequence
  CXCR4 targeting guide RNA
uauagggcggguggguggggg

SEQ ID NO: 4137 - RNA, 21 nt, Artificial Sequence
  CXCR4 targeting guide RNA
uauauagggcggguggguggg

SEQ ID NO: 4138 - RNA, 21 nt, Artificial Sequence
  CXCR4 targeting guide RNA
ucuugaccaugccuauauagg

SEQ ID NO: 4139 - RNA, 21 nt, Artificial Sequence
  CXCR4 targeting guide RNA
ugaccaugccuauauagggcg

SEQ ID NO: 4140 - RNA, 21 nt, Artificial Sequence
  CXCR4 targeting guide RNA
ugccuauauagggcggguggg

SEQ ID NO: 4141 - RNA, 21 nt, Artificial Sequence
  CXCR4 targeting guide RNA
uugaccaugccuauauagggc

SEQ ID NO: 4142 - RNA, 22 nt, Artificial Sequence
  CXCR4 targeting guide RNA
accaugccuauauagggcgggu

SEQ ID NO: 4143 - RNA, 22 nt, Artificial Sequence
  CXCR4 targeting guide RNA
acccacccgcccuauauaggca

SEQ ID NO: 4144 - RNA, 22 nt, Artificial Sequence
  CXCR4 targeting guide RNA
acccgcccuauauaggcauggu

SEQ ID NO: 4145 - RNA, 22 nt, Artificial Sequence
  CXCR4 targeting guide RNA
auauagggcggguggguggggg

SEQ ID NO: 4146 - RNA, 22 nt, Artificial Sequence
  CXCR4 targeting guide RNA
augccuauauagggcggguggg

SEQ ID NO: 4147 - RNA, 22 nt, Artificial Sequence
  CXCR4 targeting guide RNA
cacccacccgcccuauauaggc

SEQ ID NO: 4148 - RNA, 22 nt, Artificial Sequence
  CXCR4 targeting guide RNA
cacccgcccuauauaggcaugg

SEQ ID NO: 4149 - RNA, 22 nt, Artificial Sequence
  CXCR4 targeting guide RNA
caugccuauauagggcgggugg

SEQ ID NO: 4150 - RNA, 22 nt, Artificial Sequence
  CXCR4 targeting guide RNA
ccacccacccgcccuauauagg

SEQ ID NO: 4151 - RNA, 22 nt, Artificial Sequence
  CXCR4 targeting guide RNA
ccacccgcccuauauaggcaug

SEQ ID NO: 4152 - RNA, 22 nt, Artificial Sequence
  CXCR4 targeting guide RNA
ccaugccuauauagggcgggug

SEQ ID NO: 4153 - RNA, 22 nt, Artificial Sequence
  CXCR4 targeting guide RNA
cccacccacccgcccuauauag

SEQ ID NO: 4154 - RNA, 22 nt, Artificial Sequence
  CXCR4 targeting guide RNA
cccacccgcccuauauaggcau

SEQ ID NO: 4155 - RNA, 22 nt, Artificial Sequence
  CXCR4 targeting guide RNA
ccccacccacccgcccuauaua

SEQ ID NO: 4156 - RNA, 22 nt, Artificial Sequence
  CXCR4 targeting guide RNA
cccccacccacccgcccuauau

SEQ ID NO: 4157 - RNA, 22 nt, Artificial Sequence
  CXCR4 targeting guide RNA
ccccccacccacccgcccuaua

SEQ ID NO: 4158 - RNA, 22 nt, Artificial Sequence
  CXCR4 targeting guide RNA
cccgcccuauauaggcaugguc

SEQ ID NO: 4159 - RNA, 22 nt, Artificial Sequence
  CXCR4 targeting guide RNA
cccuauauaggcauggucaaga

SEQ ID NO: 4160 - RNA, 22 nt, Artificial Sequence
  CXCR4 targeting guide RNA
ccgcccuauauaggcaugguca

SEQ ID NO: 4161 - RNA, 22 nt, Artificial Sequence
  CXCR4 targeting guide RNA
ccuauauaggcauggucaagaa

SEQ ID NO: 4162 - RNA, 22 nt, Artificial Sequence
  CXCR4 targeting guide RNA
ccuauauagggcgggugggugg

SEQ ID NO: 4163 - RNA, 22 nt, Artificial Sequence
  CXCR4 targeting guide RNA
cgcccuauauaggcauggucaa

SEQ ID NO: 4164 - RNA, 22 nt, Artificial Sequence
  CXCR4 targeting guide RNA
cuauauagggcggguggguggg

SEQ ID NO: 4165 - RNA, 22 nt, Artificial Sequence
  CXCR4 targeting guide RNA
cuugaccaugccuauauagggc

SEQ ID NO: 4166 - RNA, 22 nt, Artificial Sequence
  CXCR4 targeting guide RNA
gaccaugccuauauagggcggg

SEQ ID NO: 4167 - RNA, 22 nt, Artificial Sequence
  CXCR4 targeting guide RNA
gcccuauauaggcauggucaag

SEQ ID NO: 4168 - RNA, 22 nt, Artificial Sequence
  CXCR4 targeting guide RNA
gccuauauagggcgggugggug

SEQ ID NO: 4169 - RNA, 22 nt, Artificial Sequence
  CXCR4 targeting guide RNA
uauagggcgggugggugggggg

SEQ ID NO: 4170 - RNA, 22 nt, Artificial Sequence
  CXCR4 targeting guide RNA
uauauagggcgggugggugggg

SEQ ID NO: 4171 - RNA, 22 nt, Artificial Sequence
  CXCR4 targeting guide RNA
ucuugaccaugccuauauaggg

SEQ ID NO: 4172 - RNA, 22 nt, Artificial Sequence
  CXCR4 targeting guide RNA
ugaccaugccuauauagggcgg

SEQ ID NO: 4173 - RNA, 22 nt, Artificial Sequence
  CXCR4 targeting guide RNA
ugccuauauagggcgggugggu

SEQ ID NO: 4174 - RNA, 22 nt, Artificial Sequence
  CXCR4 targeting guide RNA
uucuugaccaugccuauauagg

SEQ ID NO: 4175 - RNA, 22 nt, Artificial Sequence
  CXCR4 targeting guide RNA
uugaccaugccuauauagggcg

SEQ ID NO: 4176 - RNA, 20 nt, Artificial Sequence
  CXCR4 targeting guide RNA
aaauaacauucgcgaugucc

SEQ ID NO: 4177 - RNA, 20 nt, Artificial Sequence
  CXCR4 targeting guide RNA
aaauuccauauggacaucgc

SEQ ID NO: 4178 - RNA, 20 nt, Artificial Sequence
  CXCR4 targeting guide RNA
aacauucgcgauguccauau

SEQ ID NO: 4179 - RNA, 20 nt, Artificial Sequence
  CXCR4 targeting guide RNA
aauaacauucgcgaugucca

SEQ ID NO: 4180 - RNA, 20 nt, Artificial Sequence
  CXCR4 targeting guide RNA
aauuccauauggacaucgcg

SEQ ID NO: 4181 - RNA, 20 nt, Artificial Sequence
  CXCR4 targeting guide RNA
acaaauaacauucgcgaugu

SEQ ID NO: 4182 - RNA, 20 nt, Artificial Sequence
  CXCR4 targeting guide RNA
acaucgcgaauguuauuugu

SEQ ID NO: 4183 - RNA, 20 nt, Artificial Sequence
  CXCR4 targeting guide RNA
acauucgcgauguccauaug

SEQ ID NO: 4184 - RNA, 20 nt, Artificial Sequence
  CXCR4 targeting guide RNA
auaacauucgcgauguccau

SEQ ID NO: 4185 - RNA, 20 nt, Artificial Sequence
  CXCR4 targeting guide RNA
auauggacaucgcgaauguu

SEQ ID NO: 4186 - RNA, 20 nt, Artificial Sequence
  CXCR4 targeting guide RNA
aucgcgaauguuauuuguga

SEQ ID NO: 4187 - RNA, 20 nt, Artificial Sequence
  CXCR4 targeting guide RNA
auggacaucgcgaauguuau

SEQ ID NO: 4188 - RNA, 20 nt, Artificial Sequence
  CXCR4 targeting guide RNA
auuccauauggacaucgcga

SEQ ID NO: 4189 - RNA, 20 nt, Artificial Sequence
  CXCR4 targeting guide RNA
auucgcgauguccauaugga

SEQ ID NO: 4190 - RNA, 20 nt, Artificial Sequence
  CXCR4 targeting guide RNA
caaauaacauucgcgauguc

SEQ ID NO: 4191 - RNA, 20 nt, Artificial Sequence
  CXCR4 targeting guide RNA
cacaaauaacauucgcgaug

SEQ ID NO: 4192 - RNA, 20 nt, Artificial Sequence
  CXCR4 targeting guide RNA
cauauggacaucgcgaaugu

SEQ ID NO: 4193 - RNA, 20 nt, Artificial Sequence
  CXCR4 targeting guide RNA
caucgcgaauguuauuugug

SEQ ID NO: 4194 - RNA, 20 nt, Artificial Sequence
  CXCR4 targeting guide RNA
cauucgcgauguccauaugg

SEQ ID NO: 4195 - RNA, 20 nt, Artificial Sequence
  CXCR4 targeting guide RNA
ccauauggacaucgcgaaug

SEQ ID NO: 4196 - RNA, 20 nt, Artificial Sequence
  CXCR4 targeting guide RNA
cgaauguuauuugugaagaa

SEQ ID NO: 4197 - RNA, 20 nt, Artificial Sequence
  CXCR4 targeting guide RNA
cgcgaauguuauuugugaag

SEQ ID NO: 4198 - RNA, 20 nt, Artificial Sequence
  CXCR4 targeting guide RNA
cgcgauguccauauggaauu

SEQ ID NO: 4199 - RNA, 20 nt, Artificial Sequence
  CXCR4 targeting guide RNA
cugaaauuccauauggacau

SEQ ID NO: 4200 - RNA, 20 nt, Artificial Sequence
  CXCR4 targeting guide RNA
cuucacaaauaacauucgcg

SEQ ID NO: 4201 - RNA, 20 nt, Artificial Sequence
  CXCR4 targeting guide RNA
gaaauuccauauggacaucg

SEQ ID NO: 4202 - RNA, 20 nt, Artificial Sequence
  CXCR4 targeting guide RNA
gacaucgcgaauguuauuug

SEQ ID NO: 4203 - RNA, 20 nt, Artificial Sequence
  CXCR4 targeting guide RNA
gcgaauguuauuugugaaga

SEQ ID NO: 4204 - RNA, 20 nt, Artificial Sequence
  CXCR4 targeting guide RNA
ggacaucgcgaauguuauuu

SEQ ID NO: 4205 - RNA, 20 nt, Artificial Sequence
  CXCR4 targeting guide RNA
uaacauucgcgauguccaua

SEQ ID NO: 4206 - RNA, 20 nt, Artificial Sequence
  CXCR4 targeting guide RNA
uauggacaucgcgaauguua

SEQ ID NO: 4207 - RNA, 20 nt, Artificial Sequence
  CXCR4 targeting guide RNA
ucacaaauaacauucgcgau

SEQ ID NO: 4208 - RNA, 20 nt, Artificial Sequence
  CXCR4 targeting guide RNA
uccauauggacaucgcgaau

SEQ ID NO: 4209 - RNA, 20 nt, Artificial Sequence
  CXCR4 targeting guide RNA
ucgcgaauguuauuugugaa

SEQ ID NO: 4210 - RNA, 20 nt, Artificial Sequence
  CXCR4 targeting guide RNA
ucgcgauguccauauggaau

SEQ ID NO: 4211 - RNA, 20 nt, Artificial Sequence
  CXCR4 targeting guide RNA
ucuucacaaauaacauucgc

SEQ ID NO: 4212 - RNA, 20 nt, Artificial Sequence
  CXCR4 targeting guide RNA
ugaaauuccauauggacauc

SEQ ID NO: 4213 - RNA, 20 nt, Artificial Sequence
  CXCR4 targeting guide RNA
uggacaucgcgaauguuauu

SEQ ID NO: 4214 - RNA, 20 nt, Artificial Sequence
  CXCR4 targeting guide RNA
uucacaaauaacauucgcga

SEQ ID NO: 4215 - RNA, 20 nt, Artificial Sequence
  CXCR4 targeting guide RNA
uuccauauggacaucgcgaa

SEQ ID NO: 4216 - RNA, 20 nt, Artificial Sequence
  CXCR4 targeting guide RNA
uucgcgauguccauauggaa

SEQ ID NO: 4217 - RNA, 20 nt, Artificial Sequence
  CXCR4 targeting guide RNA
uucuucacaaauaacauucg

SEQ ID NO: 4218 - RNA, 21 nt, Artificial Sequence
  CXCR4 targeting guide RNA
aaauaacauucgcgaugucca

SEQ ID NO: 4219 - RNA, 21 nt, Artificial Sequence
  CXCR4 targeting guide RNA
aaauuccauauggacaucgcg

SEQ ID NO: 4220 - RNA, 21 nt, Artificial Sequence
  CXCR4 targeting guide RNA
aacauucgcgauguccauaug

SEQ ID NO: 4221 - RNA, 21 nt, Artificial Sequence
  CXCR4 targeting guide RNA
aauaacauucgcgauguccau

SEQ ID NO: 4222 - RNA, 21 nt, Artificial Sequence
  CXCR4 targeting guide RNA
aauuccauauggacaucgcga

SEQ ID NO: 4223 - RNA, 21 nt, Artificial Sequence
  CXCR4 targeting guide RNA
acaaauaacauucgcgauguc

SEQ ID NO: 4224 - RNA, 21 nt, Artificial Sequence
  CXCR4 targeting guide RNA
acaucgcgaauguuauuugug

SEQ ID NO: 4225 - RNA, 21 nt, Artificial Sequence
  CXCR4 targeting guide RNA
acauucgcgauguccauaugg

SEQ ID NO: 4226 - RNA, 21 nt, Artificial Sequence
  CXCR4 targeting guide RNA
auaacauucgcgauguccaua

SEQ ID NO: 4227 - RNA, 21 nt, Artificial Sequence
  CXCR4 targeting guide RNA
auauggacaucgcgaauguua

SEQ ID NO: 4228 - RNA, 21 nt, Artificial Sequence
  CXCR4 targeting guide RNA
aucgcgaauguuauuugugaa

SEQ ID NO: 4229 - RNA, 21 nt, Artificial Sequence
  CXCR4 targeting guide RNA
auggacaucgcgaauguuauu

SEQ ID NO: 4230 - RNA, 21 nt, Artificial Sequence
  CXCR4 targeting guide RNA
auuccauauggacaucgcgaa

SEQ ID NO: 4231 - RNA, 21 nt, Artificial Sequence
  CXCR4 targeting guide RNA
auucgcgauguccauauggaa

SEQ ID NO: 4232 - RNA, 21 nt, Artificial Sequence
  CXCR4 targeting guide RNA
caaauaacauucgcgaugucc

SEQ ID NO: 4233 - RNA, 21 nt, Artificial Sequence
  CXCR4 targeting guide RNA
cacaaauaacauucgcgaugu

SEQ ID NO: 4234 - RNA, 21 nt, Artificial Sequence
  CXCR4 targeting guide RNA
cauauggacaucgcgaauguu

SEQ ID NO: 4235 - RNA, 21 nt, Artificial Sequence
  CXCR4 targeting guide RNA
caucgcgaauguuauuuguga

SEQ ID NO: 4236 - RNA, 21 nt, Artificial Sequence
  CXCR4 targeting guide RNA
cauucgcgauguccauaugga

SEQ ID NO: 4237 - RNA, 21 nt, Artificial Sequence
  CXCR4 targeting guide RNA
ccauauggacaucgcgaaugu

SEQ ID NO: 4238 - RNA, 21 nt, Artificial Sequence
  CXCR4 targeting guide RNA
cgcgaauguuauuugugaaga

SEQ ID NO: 4239 - RNA, 21 nt, Artificial Sequence
  CXCR4 targeting guide RNA
cgcgauguccauauggaauuu

SEQ ID NO: 4240 - RNA, 21 nt, Artificial Sequence
  CXCR4 targeting guide RNA
cugaaauuccauauggacauc

SEQ ID NO: 4241 - RNA, 21 nt, Artificial Sequence
  CXCR4 targeting guide RNA
cuucacaaauaacauucgcga

SEQ ID NO: 4242 - RNA, 21 nt, Artificial Sequence
  CXCR4 targeting guide RNA
gaaauuccauauggacaucgc

SEQ ID NO: 4243 - RNA, 21 nt, Artificial Sequence
  CXCR4 targeting guide RNA
gacaucgcgaauguuauuugu

SEQ ID NO: 4244 - RNA, 21 nt, Artificial Sequence
  CXCR4 targeting guide RNA
gcgaauguuauuugugaagaa

SEQ ID NO: 4245 - RNA, 21 nt, Artificial Sequence
  CXCR4 targeting guide RNA
ggacaucgcgaauguuauuug

SEQ ID NO: 4246 - RNA, 21 nt, Artificial Sequence
  CXCR4 targeting guide RNA
uaacauucgcgauguccauau

SEQ ID NO: 4247 - RNA, 21 nt, Artificial Sequence
  CXCR4 targeting guide RNA
uauggacaucgcgaauguuau

SEQ ID NO: 4248 - RNA, 21 nt, Artificial Sequence
  CXCR4 targeting guide RNA
ucacaaauaacauucgcgaug

SEQ ID NO: 4249 - RNA, 21 nt, Artificial Sequence
  CXCR4 targeting guide RNA
uccauauggacaucgcgaaug

SEQ ID NO: 4250 - RNA, 21 nt, Artificial Sequence
  CXCR4 targeting guide RNA
ucgcgaauguuauuugugaag

SEQ ID NO: 4251 - RNA, 21 nt, Artificial Sequence
  CXCR4 targeting guide RNA
ucgcgauguccauauggaauu

SEQ ID NO: 4252 - RNA, 21 nt, Artificial Sequence
  CXCR4 targeting guide RNA
ucugaaauuccauauggacau

SEQ ID NO: 4253 - RNA, 21 nt, Artificial Sequence
  CXCR4 targeting guide RNA
ucuucacaaauaacauucgcg

SEQ ID NO: 4254 - RNA, 21 nt, Artificial Sequence
  CXCR4 targeting guide RNA
ugaaauuccauauggacaucg

SEQ ID NO: 4255 - RNA, 21 nt, Artificial Sequence
  CXCR4 targeting guide RNA
uggacaucgcgaauguuauuu

SEQ ID NO: 4256 - RNA, 21 nt, Artificial Sequence
  CXCR4 targeting guide RNA
uucacaaauaacauucgcgau

SEQ ID NO: 4257 - RNA, 21 nt, Artificial Sequence
  CXCR4 targeting guide RNA
uuccauauggacaucgcgaau

SEQ ID NO: 4258 - RNA, 21 nt, Artificial Sequence
  CXCR4 targeting guide RNA
uucgcgauguccauauggaau

SEQ ID NO: 4259 - RNA, 21 nt, Artificial Sequence
  CXCR4 targeting guide RNA
uucuucacaaauaacauucgc

SEQ ID NO: 4260 - RNA, 22 nt, Artificial Sequence
  CXCR4 targeting guide RNA
aaauaacauucgcgauguccau

SEQ ID NO: 4261 - RNA, 22 nt, Artificial Sequence
  CXCR4 targeting guide RNA
aaauuccauauggacaucgcga

SEQ ID NO: 4262 - RNA, 22 nt, Artificial Sequence
  CXCR4 targeting guide RNA
aacauucgcgauguccauaugg

SEQ ID NO: 4263 - RNA, 22 nt, Artificial Sequence
  CXCR4 targeting guide RNA
aauaacauucgcgauguccaua

SEQ ID NO: 4264 - RNA, 22 nt, Artificial Sequence
  CXCR4 targeting guide RNA
aauuccauauggacaucgcgaa

SEQ ID NO: 4265 - RNA, 22 nt, Artificial Sequence
  CXCR4 targeting guide RNA
acaaauaacauucgcgaugucc

SEQ ID NO: 4266 - RNA, 22 nt, Artificial Sequence
  CXCR4 targeting guide RNA
acaucgcgaauguuauuuguga

SEQ ID NO: 4267 - RNA, 22 nt, Artificial Sequence
  CXCR4 targeting guide RNA
acauucgcgauguccauaugga

SEQ ID NO: 4268 - RNA, 22 nt, Artificial Sequence
  CXCR4 targeting guide RNA
auaacauucgcgauguccauau

SEQ ID NO: 4269 - RNA, 22 nt, Artificial Sequence
  CXCR4 targeting guide RNA
auauggacaucgcgaauguuau

SEQ ID NO: 4270 - RNA, 22 nt, Artificial Sequence
  CXCR4 targeting guide RNA
aucgcgaauguuauuugugaag

SEQ ID NO: 4271 - RNA, 22 nt, Artificial Sequence
  CXCR4 targeting guide RNA
aucugaaauuccauauggacau

SEQ ID NO: 4272 - RNA, 22 nt, Artificial Sequence
  CXCR4 targeting guide RNA
auggacaucgcgaauguuauuu

SEQ ID NO: 4273 - RNA, 22 nt, Artificial Sequence
  CXCR4 targeting guide RNA
auuccauauggacaucgcgaau

SEQ ID NO: 4274 - RNA, 22 nt, Artificial Sequence
  CXCR4 targeting guide RNA
auucgcgauguccauauggaau

SEQ ID NO: 4275 - RNA, 22 nt, Artificial Sequence
  CXCR4 targeting guide RNA
auucuucacaaauaacauucgc

SEQ ID NO: 4276 - RNA, 22 nt, Artificial Sequence
  CXCR4 targeting guide RNA
caaauaacauucgcgaugucca

SEQ ID NO: 4277 - RNA, 22 nt, Artificial Sequence
  CXCR4 targeting guide RNA
cacaaauaacauucgcgauguc

SEQ ID NO: 4278 - RNA, 22 nt, Artificial Sequence
  CXCR4 targeting guide RNA
cauauggacaucgcgaauguua

SEQ ID NO: 4279 - RNA, 22 nt, Artificial Sequence
  CXCR4 targeting guide RNA
caucgcgaauguuauuugugaa

SEQ ID NO: 4280 - RNA, 22 nt, Artificial Sequence
  CXCR4 targeting guide RNA
cauucgcgauguccauauggaa

SEQ ID NO: 4281 - RNA, 22 nt, Artificial Sequence
  CXCR4 targeting guide RNA
ccauauggacaucgcgaauguu

SEQ ID NO: 4282 - RNA, 22 nt, Artificial Sequence
  CXCR4 targeting guide RNA
cgcgaauguuauuugugaagaa

SEQ ID NO: 4283 - RNA, 22 nt, Artificial Sequence
  CXCR4 targeting guide RNA
cgcgauguccauauggaauuuc

SEQ ID NO: 4284 - RNA, 22 nt, Artificial Sequence
  CXCR4 targeting guide RNA
cugaaauuccauauggacaucg

SEQ ID NO: 4285 - RNA, 22 nt, Artificial Sequence
  CXCR4 targeting guide RNA
cuucacaaauaacauucgcgau

SEQ ID NO: 4286 - RNA, 22 nt, Artificial Sequence
  CXCR4 targeting guide RNA
gaaauuccauauggacaucgcg

SEQ ID NO: 4287 - RNA, 22 nt, Artificial Sequence
  CXCR4 targeting guide RNA
gacaucgcgaauguuauuugug

SEQ ID NO: 4288 - RNA, 22 nt, Artificial Sequence
  CXCR4 targeting guide RNA
gcgaauguuauuugugaagaau

SEQ ID NO: 4289 - RNA, 22 nt, Artificial Sequence
  CXCR4 targeting guide RNA
ggacaucgcgaauguuauuugu

SEQ ID NO: 4290 - RNA, 22 nt, Artificial Sequence
  CXCR4 targeting guide RNA
uaacauucgcgauguccauaug

SEQ ID NO: 4291 - RNA, 22 nt, Artificial Sequence
  CXCR4 targeting guide RNA
uauggacaucgcgaauguuauu

SEQ ID NO: 4292 - RNA, 22 nt, Artificial Sequence
  CXCR4 targeting guide RNA
ucacaaauaacauucgcgaugu

SEQ ID NO: 4293 - RNA, 22 nt, Artificial Sequence
  CXCR4 targeting guide RNA
uccauauggacaucgcgaaugu

SEQ ID NO: 4294 - RNA, 22 nt, Artificial Sequence
  CXCR4 targeting guide RNA
ucgcgaauguuauuugugaaga

SEQ ID NO: 4295 - RNA, 22 nt, Artificial Sequence
  CXCR4 targeting guide RNA
ucgcgauguccauauggaauuu

SEQ ID NO: 4296 - RNA, 22 nt, Artificial Sequence
  CXCR4 targeting guide RNA
ucugaaauuccauauggacauc

SEQ ID NO: 4297 - RNA, 22 nt, Artificial Sequence
  CXCR4 targeting guide RNA
ucuucacaaauaacauucgcga

SEQ ID NO: 4298 - RNA, 22 nt, Artificial Sequence
  CXCR4 targeting guide RNA
ugaaauuccauauggacaucgc

SEQ ID NO: 4299 - RNA, 22 nt, Artificial Sequence
  CXCR4 targeting guide RNA
uggacaucgcgaauguuauuug

SEQ ID NO: 4300 - RNA, 22 nt, Artificial Sequence
  CXCR4 targeting guide RNA
uucacaaauaacauucgcgaug

SEQ ID NO: 4301 - RNA, 22 nt, Artificial Sequence
  CXCR4 targeting guide RNA
uuccauauggacaucgcgaaug

SEQ ID NO: 4302 - RNA, 22 nt, Artificial Sequence
  CXCR4 targeting guide RNA
uucgcgauguccauauggaauu

SEQ ID NO: 4303 - RNA, 22 nt, Artificial Sequence
  CXCR4 targeting guide RNA
uucuucacaaauaacauucgcg

SEQ ID NO: 4304 - RNA, 20 nt, Artificial Sequence
  CXCR4 targeting guide RNA
aaauaacauucacgaugucc

SEQ ID NO: 4305 - RNA, 20 nt, Artificial Sequence
  CXCR4 targeting guide RNA
aaauuccauauggacaucgu

SEQ ID NO: 4306 - RNA, 20 nt, Artificial Sequence
  CXCR4 targeting guide RNA
aacauucacgauguccauau

SEQ ID NO: 4307 - RNA, 20 nt, Artificial Sequence
  CXCR4 targeting guide RNA
aauaacauucacgaugucca

SEQ ID NO: 4308 - RNA, 20 nt, Artificial Sequence
  CXCR4 targeting guide RNA
aauuccauauggacaucgug

SEQ ID NO: 4309 - RNA, 20 nt, Artificial Sequence
  CXCR4 targeting guide RNA
acaaauaacauucacgaugu

SEQ ID NO: 4310 - RNA, 20 nt, Artificial Sequence
  CXCR4 targeting guide RNA
acaucgugaauguuauuugu

SEQ ID NO: 4311 - RNA, 20 nt, Artificial Sequence
  CXCR4 targeting guide RNA
acauucacgauguccauaug

SEQ ID NO: 4312 - RNA, 20 nt, Artificial Sequence
  CXCR4 targeting guide RNA
auaacauucacgauguccau

SEQ ID NO: 4313 - RNA, 20 nt, Artificial Sequence
  CXCR4 targeting guide RNA
auauggacaucgugaauguu

SEQ ID NO: 4314 - RNA, 20 nt, Artificial Sequence
  CXCR4 targeting guide RNA
aucgugaauguuauuuguga

SEQ ID NO: 4315 - RNA, 20 nt, Artificial Sequence
  CXCR4 targeting guide RNA
auggacaucgugaauguuau

SEQ ID NO: 4316 - RNA, 20 nt, Artificial Sequence
  CXCR4 targeting guide RNA
auucacgauguccauaugga

SEQ ID NO: 4317 - RNA, 20 nt, Artificial Sequence
  CXCR4 targeting guide RNA
auuccauauggacaucguga

SEQ ID NO: 4318 - RNA, 20 nt, Artificial Sequence
  CXCR4 targeting guide RNA
caaauaacauucacgauguc

SEQ ID NO: 4319 - RNA, 20 nt, Artificial Sequence
  CXCR4 targeting guide RNA
cacaaauaacauucacgaug

SEQ ID NO: 4320 - RNA, 20 nt, Artificial Sequence
  CXCR4 targeting guide RNA
cacgauguccauauggaauu

SEQ ID NO: 4321 - RNA, 20 nt, Artificial Sequence
  CXCR4 targeting guide RNA
cauauggacaucgugaaugu

SEQ ID NO: 4322 - RNA, 20 nt, Artificial Sequence
  CXCR4 targeting guide RNA
caucgugaauguuauuugug

SEQ ID NO: 4323 - RNA, 20 nt, Artificial Sequence
  CXCR4 targeting guide RNA
cauucacgauguccauaugg

SEQ ID NO: 4324 - RNA, 20 nt, Artificial Sequence
  CXCR4 targeting guide RNA
ccauauggacaucgugaaug

SEQ ID NO: 4325 - RNA, 20 nt, Artificial Sequence
  CXCR4 targeting guide RNA
cgugaauguuauuugugaag

SEQ ID NO: 4326 - RNA, 20 nt, Artificial Sequence
  CXCR4 targeting guide RNA
cuucacaaauaacauucacg

SEQ ID NO: 4327 - RNA, 20 nt, Artificial Sequence
  CXCR4 targeting guide RNA
gacaucgugaauguuauuug

SEQ ID NO: 4328 - RNA, 20 nt, Artificial Sequence
  CXCR4 targeting guide RNA
ggacaucgugaauguuauuu

SEQ ID NO: 4329 - RNA, 20 nt, Artificial Sequence
  CXCR4 targeting guide RNA
gugaauguuauuugugaaga

SEQ ID NO: 4330 - RNA, 20 nt, Artificial Sequence
  CXCR4 targeting guide RNA
uaacauucacgauguccaua

SEQ ID NO: 4331 - RNA, 20 nt, Artificial Sequence
  CXCR4 targeting guide RNA
uauggacaucgugaauguua

SEQ ID NO: 4332 - RNA, 20 nt, Artificial Sequence
  CXCR4 targeting guide RNA
ucacaaauaacauucacgau

SEQ ID NO: 4333 - RNA, 20 nt, Artificial Sequence
  CXCR4 targeting guide RNA
ucacgauguccauauggaau

SEQ ID NO: 4334 - RNA, 20 nt, Artificial Sequence
  CXCR4 targeting guide RNA
uccauauggacaucgugaau

SEQ ID NO: 4335 - RNA, 20 nt, Artificial Sequence
  CXCR4 targeting guide RNA
ucgugaauguuauuugugaa

SEQ ID NO: 4336 - RNA, 20 nt, Artificial Sequence
  CXCR4 targeting guide RNA
ucuucacaaauaacauucac

SEQ ID NO: 4337 - RNA, 20 nt, Artificial Sequence
  CXCR4 targeting guide RNA
uggacaucgugaauguuauu

SEQ ID NO: 4338 - RNA, 20 nt, Artificial Sequence
  CXCR4 targeting guide RNA
uucacaaauaacauucacga

SEQ ID NO: 4339 - RNA, 20 nt, Artificial Sequence
  CXCR4 targeting guide RNA
uucacgauguccauauggaa

SEQ ID NO: 4340 - RNA, 20 nt, Artificial Sequence
  CXCR4 targeting guide RNA
uuccauauggacaucgugaa

SEQ ID NO: 4341 - RNA, 21 nt, Artificial Sequence
  CXCR4 targeting guide RNA
aaauaacauucacgaugucca

SEQ ID NO: 4342 - RNA, 21 nt, Artificial Sequence
  CXCR4 targeting guide RNA
aaauuccauauggacaucgug

SEQ ID NO: 4343 - RNA, 21 nt, Artificial Sequence
  CXCR4 targeting guide RNA
aacauucacgauguccauaug

SEQ ID NO: 4344 - RNA, 21 nt, Artificial Sequence
  CXCR4 targeting guide RNA
aauaacauucacgauguccau

SEQ ID NO: 4345 - RNA, 21 nt, Artificial Sequence
  CXCR4 targeting guide RNA
aauuccauauggacaucguga

SEQ ID NO: 4346 - RNA, 21 nt, Artificial Sequence
  CXCR4 targeting guide RNA
acaaauaacauucacgauguc

SEQ ID NO: 4347 - RNA, 21 nt, Artificial Sequence
  CXCR4 targeting guide RNA
acaucgugaauguuauuugug

SEQ ID NO: 4348 - RNA, 21 nt, Artificial Sequence
  CXCR4 targeting guide RNA
acauucacgauguccauaugg

SEQ ID NO: 4349 - RNA, 21 nt, Artificial Sequence
  CXCR4 targeting guide RNA
auaacauucacgauguccaua

SEQ ID NO: 4350 - RNA, 21 nt, Artificial Sequence
  CXCR4 targeting guide RNA
auauggacaucgugaauguua

SEQ ID NO: 4351 - RNA, 21 nt, Artificial Sequence
  CXCR4 targeting guide RNA
auggacaucgugaauguuauu

SEQ ID NO: 4352 - RNA, 21 nt, Artificial Sequence
  CXCR4 targeting guide RNA
auucacgauguccauauggaa

SEQ ID NO: 4353 - RNA, 21 nt, Artificial Sequence
  CXCR4 targeting guide RNA
auuccauauggacaucgugaa

SEQ ID NO: 4354 - RNA, 21 nt, Artificial Sequence
  CXCR4 targeting guide RNA
caaauaacauucacgaugucc

SEQ ID NO: 4355 - RNA, 21 nt, Artificial Sequence
  CXCR4 targeting guide RNA
cacaaauaacauucacgaugu

SEQ ID NO: 4356 - RNA, 21 nt, Artificial Sequence
  CXCR4 targeting guide RNA
cacgauguccauauggaauuu

SEQ ID NO: 4357 - RNA, 21 nt, Artificial Sequence
  CXCR4 targeting guide RNA
cauauggacaucgugaauguu

SEQ ID NO: 4358 - RNA, 21 nt, Artificial Sequence
  CXCR4 targeting guide RNA
caucgugaauguuauuuguga

SEQ ID NO: 4359 - RNA, 21 nt, Artificial Sequence
  CXCR4 targeting guide RNA
cauucacgauguccauaugga

SEQ ID NO: 4360 - RNA, 21 nt, Artificial Sequence
  CXCR4 targeting guide RNA
ccauauggacaucgugaaugu

SEQ ID NO: 4361 - RNA, 21 nt, Artificial Sequence
  CXCR4 targeting guide RNA
cgugaauguuauuugugaaga

SEQ ID NO: 4362 - RNA, 21 nt, Artificial Sequence
  CXCR4 targeting guide RNA
cuucacaaauaacauucacga

SEQ ID NO: 4363 - RNA, 21 nt, Artificial Sequence
  CXCR4 targeting guide RNA
gaaauuccauauggacaucgu

SEQ ID NO: 4364 - RNA, 21 nt, Artificial Sequence
  CXCR4 targeting guide RNA
gacaucgugaauguuauuugu

SEQ ID NO: 4365 - RNA, 21 nt, Artificial Sequence
  CXCR4 targeting guide RNA
ggacaucgugaauguuauuug

SEQ ID NO: 4366 - RNA, 21 nt, Artificial Sequence
  CXCR4 targeting guide RNA
uaacauucacgauguccauau

SEQ ID NO: 4367 - RNA, 21 nt, Artificial Sequence
  CXCR4 targeting guide RNA
uauggacaucgugaauguuau

SEQ ID NO: 4368 - RNA, 21 nt, Artificial Sequence
  CXCR4 targeting guide RNA
ucacaaauaacauucacgaug

SEQ ID NO: 4369 - RNA, 21 nt, Artificial Sequence
  CXCR4 targeting guide RNA
ucacgauguccauauggaauu

SEQ ID NO: 4370 - RNA, 21 nt, Artificial Sequence
  CXCR4 targeting guide RNA
uccauauggacaucgugaaug

SEQ ID NO: 4371 - RNA, 21 nt, Artificial Sequence
  CXCR4 targeting guide RNA
ucgugaauguuauuugugaag

SEQ ID NO: 4372 - RNA, 21 nt, Artificial Sequence
  CXCR4 targeting guide RNA
ucuucacaaauaacauucacg

SEQ ID NO: 4373 - RNA, 21 nt, Artificial Sequence
  CXCR4 targeting guide RNA
uggacaucgugaauguuauuu

SEQ ID NO: 4374 - RNA, 21 nt, Artificial Sequence
  CXCR4 targeting guide RNA
uucacgauguccauauggaau

SEQ ID NO: 4375 - RNA, 21 nt, Artificial Sequence
  CXCR4 targeting guide RNA
uuccauauggacaucgugaau

SEQ ID NO: 4376 - RNA, 22 nt, Artificial Sequence
  CXCR4 targeting guide RNA
aaauaacauucacgauguccau

SEQ ID NO: 4377 - RNA, 22 nt, Artificial Sequence
  CXCR4 targeting guide RNA
aaauuccauauggacaucguga

SEQ ID NO: 4378 - RNA, 22 nt, Artificial Sequence
  CXCR4 targeting guide RNA
aacauucacgauguccauaugg

SEQ ID NO: 4379 - RNA, 22 nt, Artificial Sequence
  CXCR4 targeting guide RNA
aauaacauucacgauguccaua

SEQ ID NO: 4380 - RNA, 22 nt, Artificial Sequence
  CXCR4 targeting guide RNA
aauuccauauggacaucgugaa

SEQ ID NO: 4381 - RNA, 22 nt, Artificial Sequence
  CXCR4 targeting guide RNA
acaaauaacauucacgaugucc

SEQ ID NO: 4382 - RNA, 22 nt, Artificial Sequence
  CXCR4 targeting guide RNA
acaucgugaauguuauuuguga

SEQ ID NO: 4383 - RNA, 22 nt, Artificial Sequence
  CXCR4 targeting guide RNA
acauucacgauguccauaugga

SEQ ID NO: 4384 - RNA, 22 nt, Artificial Sequence
  CXCR4 targeting guide RNA
auaacauucacgauguccauau

SEQ ID NO: 4385 - RNA, 22 nt, Artificial Sequence
  CXCR4 targeting guide RNA
auauggacaucgugaauguuau

SEQ ID NO: 4386 - RNA, 22 nt, Artificial Sequence
  CXCR4 targeting guide RNA
aucgugaauguuauuugugaag

SEQ ID NO: 4387 - RNA, 22 nt, Artificial Sequence
  CXCR4 targeting guide RNA
auggacaucgugaauguuauuu

SEQ ID NO: 4388 - RNA, 22 nt, Artificial Sequence
  CXCR4 targeting guide RNA
auucacgauguccauauggaau

SEQ ID NO: 4389 - RNA, 22 nt, Artificial Sequence
  CXCR4 targeting guide RNA
auuccauauggacaucgugaau

SEQ ID NO: 4390 - RNA, 22 nt, Artificial Sequence
  CXCR4 targeting guide RNA
caaauaacauucacgaugucca

SEQ ID NO: 4391 - RNA, 22 nt, Artificial Sequence
  CXCR4 targeting guide RNA
cacaaauaacauucacgauguc

SEQ ID NO: 4392 - RNA, 22 nt, Artificial Sequence
  CXCR4 targeting guide RNA
cacgauguccauauggaauuuc

SEQ ID NO: 4393 - RNA, 22 nt, Artificial Sequence
  CXCR4 targeting guide RNA
cauauggacaucgugaauguua

SEQ ID NO: 4394 - RNA, 22 nt, Artificial Sequence
  CXCR4 targeting guide RNA
caucgugaauguuauuugugaa

SEQ ID NO: 4395 - RNA, 22 nt, Artificial Sequence
  CXCR4 targeting guide RNA
cauucacgauguccauauggaa

SEQ ID NO: 4396 - RNA, 22 nt, Artificial Sequence
  CXCR4 targeting guide RNA
ccauauggacaucgugaauguu

SEQ ID NO: 4397 - RNA, 22 nt, Artificial Sequence
  CXCR4 targeting guide RNA
cgugaauguuauuugugaagaa

SEQ ID NO: 4398 - RNA, 22 nt, Artificial Sequence
  CXCR4 targeting guide RNA
cuucacaaauaacauucacgau

SEQ ID NO: 4399 - RNA, 22 nt, Artificial Sequence
  CXCR4 targeting guide RNA
gaaauuccauauggacaucgug

SEQ ID NO: 4400 - RNA, 22 nt, Artificial Sequence
  CXCR4 targeting guide RNA
gacaucgugaauguuauuugug

SEQ ID NO: 4401 - RNA, 22 nt, Artificial Sequence
  CXCR4 targeting guide RNA
ggacaucgugaauguuauuugu

SEQ ID NO: 4402 - RNA, 22 nt, Artificial Sequence
  CXCR4 targeting guide RNA
uaacauucacgauguccauaug

SEQ ID NO: 4403 - RNA, 22 nt, Artificial Sequence
  CXCR4 targeting guide RNA
uauggacaucgugaauguuauu

SEQ ID NO: 4404 - RNA, 22 nt, Artificial Sequence
  CXCR4 targeting guide RNA
ucacaaauaacauucacgaugu

SEQ ID NO: 4405 - RNA, 22 nt, Artificial Sequence
  CXCR4 targeting guide RNA
ucacgauguccauauggaauuu

SEQ ID NO: 4406 - RNA, 22 nt, Artificial Sequence
  CXCR4 targeting guide RNA
uccauauggacaucgugaaugu

SEQ ID NO: 4407 - RNA, 22 nt, Artificial Sequence
  CXCR4 targeting guide RNA
ucgugaauguuauuugugaaga

SEQ ID NO: 4408 - RNA, 22 nt, Artificial Sequence
  CXCR4 targeting guide RNA
ucuucacaaauaacauucacga

SEQ ID NO: 4409 - RNA, 22 nt, Artificial Sequence
  CXCR4 targeting guide RNA
ugaaauuccauauggacaucgu

SEQ ID NO: 4410 - RNA, 22 nt, Artificial Sequence
  CXCR4 targeting guide RNA
uggacaucgugaauguuauuug

SEQ ID NO: 4411 - RNA, 22 nt, Artificial Sequence
  CXCR4 targeting guide RNA
uucacaaauaacauucacgaug

SEQ ID NO: 4412 - RNA, 22 nt, Artificial Sequence
  CXCR4 targeting guide RNA
uucacgauguccauauggaauu

SEQ ID NO: 4413 - RNA, 22 nt, Artificial Sequence
  CXCR4 targeting guide RNA
uuccauauggacaucgugaaug

SEQ ID NO: 4414 - RNA, 22 nt, Artificial Sequence
  CXCR4 targeting guide RNA
uucuucacaaauaacauucacg

SEQ ID NO: 4415 - RNA, 20 nt, Artificial Sequence
  CXCR4 targeting guide RNA
aaaaaagucugacaucuuag

SEQ ID NO: 4416 - RNA, 20 nt, Artificial Sequence
  CXCR4 targeting guide RNA
aaaaagucugacaucuuagu

SEQ ID NO: 4417 - RNA, 20 nt, Artificial Sequence
  CXCR4 targeting guide RNA
aaaagucugacaucuuagua

SEQ ID NO: 4418 - RNA, 20 nt, Artificial Sequence
  CXCR4 targeting guide RNA
aaaguaucuacuaagauguc

SEQ ID NO: 4419 - RNA, 20 nt, Artificial Sequence
  CXCR4 targeting guide RNA
aaagucugacaucuuaguag

SEQ ID NO: 4420 - RNA, 20 nt, Artificial Sequence
  CXCR4 targeting guide RNA
aagaugucagacuuuuuuca

SEQ ID NO: 4421 - RNA, 20 nt, Artificial Sequence
  CXCR4 targeting guide RNA
aaggacuauugugaaaaaag

SEQ ID NO: 4422 - RNA, 20 nt, Artificial Sequence
  CXCR4 targeting guide RNA
aaguaucuacuaagauguca

SEQ ID NO: 4423 - RNA, 20 nt, Artificial Sequence
  CXCR4 targeting guide RNA
aagucugacaucuuaguaga

SEQ ID NO: 4424 - RNA, 20 nt, Artificial Sequence
  CXCR4 targeting guide RNA
acuaagaugucagacuuuuu

SEQ ID NO: 4425 - RNA, 20 nt, Artificial Sequence
  CXCR4 targeting guide RNA
acuauugugaaaaaagucug

SEQ ID NO: 4426 - RNA, 20 nt, Artificial Sequence
  CXCR4 targeting guide RNA
agaugucagacuuuuuucac

SEQ ID NO: 4427 - RNA, 20 nt, Artificial Sequence
  CXCR4 targeting guide RNA
aggacuauugugaaaaaagu

SEQ ID NO: 4428 - RNA, 20 nt, Artificial Sequence
  CXCR4 targeting guide RNA
aguaucuacuaagaugucag

SEQ ID NO: 4429 - RNA, 20 nt, Artificial Sequence
  CXCR4 targeting guide RNA
agucugacaucuuaguagau

SEQ ID NO: 4430 - RNA, 20 nt, Artificial Sequence
  CXCR4 targeting guide RNA
aucuacuaagaugucagacu

SEQ ID NO: 4431 - RNA, 20 nt, Artificial Sequence
  CXCR4 targeting guide RNA
augucagacuuuuuucacaa

SEQ ID NO: 4432 - RNA, 20 nt, Artificial Sequence
  CXCR4 targeting guide RNA
auugugaaaaaagucugaca

SEQ ID NO: 4433 - RNA, 20 nt, Artificial Sequence
  CXCR4 targeting guide RNA
cagacuuuuuucacaauagu

SEQ ID NO: 4434 - RNA, 20 nt, Artificial Sequence
  CXCR4 targeting guide RNA
cuaaaguaucuacuaagaug

SEQ ID NO: 4435 - RNA, 20 nt, Artificial Sequence
  CXCR4 targeting guide RNA
cuaagaugucagacuuuuuu

SEQ ID NO: 4436 - RNA, 20 nt, Artificial Sequence
  CXCR4 targeting guide RNA
cuacuaagaugucagacuuu

SEQ ID NO: 4437 - RNA, 20 nt, Artificial Sequence
  CXCR4 targeting guide RNA
cuauugugaaaaaagucuga

SEQ ID NO: 4438 - RNA, 20 nt, Artificial Sequence
  CXCR4 targeting guide RNA
cugacaucuuaguagauacu

SEQ ID NO: 4439 - RNA, 20 nt, Artificial Sequence
  CXCR4 targeting guide RNA
gaaaaaagucugacaucuua

SEQ ID NO: 4440 - RNA, 20 nt, Artificial Sequence
  CXCR4 targeting guide RNA
gacuauugugaaaaaagucu

SEQ ID NO: 4441 - RNA, 20 nt, Artificial Sequence
  CXCR4 targeting guide RNA
gaugucagacuuuuuucaca

SEQ ID NO: 4442 - RNA, 20 nt, Artificial Sequence
  CXCR4 targeting guide RNA
ggacuauugugaaaaaaguc

SEQ ID NO: 4443 - RNA, 20 nt, Artificial Sequence
  CXCR4 targeting guide RNA
guaucuacuaagaugucaga

SEQ ID NO: 4444 - RNA, 20 nt, Artificial Sequence
  CXCR4 targeting guide RNA
gucagacuuuuuucacaaua

SEQ ID NO: 4445 - RNA, 20 nt, Artificial Sequence
  CXCR4 targeting guide RNA
gucugacaucuuaguagaua

SEQ ID NO: 4446 - RNA, 20 nt, Artificial Sequence
  CXCR4 targeting guide RNA
gugaaaaaagucugacaucu

SEQ ID NO: 4447 - RNA, 20 nt, Artificial Sequence
  CXCR4 targeting guide RNA
uaagaugucagacuuuuuuc

SEQ ID NO: 4448 - RNA, 20 nt, Artificial Sequence
  CXCR4 targeting guide RNA
uacuaagaugucagacuuuu

SEQ ID NO: 4449 - RNA, 20 nt, Artificial Sequence
  CXCR4 targeting guide RNA
uaucuacuaagaugucagac

SEQ ID NO: 4450 - RNA, 20 nt, Artificial Sequence
  CXCR4 targeting guide RNA
uauugugaaaaaagucugac

SEQ ID NO: 4451 - RNA, 20 nt, Artificial Sequence
  CXCR4 targeting guide RNA
ucagacuuuuuucacaauag

SEQ ID NO: 4452 - RNA, 20 nt, Artificial Sequence
  CXCR4 targeting guide RNA
ucuacuaagaugucagacuu

SEQ ID NO: 4453 - RNA, 20 nt, Artificial Sequence
  CXCR4 targeting guide RNA
ucugacaucuuaguagauac

SEQ ID NO: 4454 - RNA, 20 nt, Artificial Sequence
  CXCR4 targeting guide RNA
ugaaaaaagucugacaucuu

SEQ ID NO: 4455 - RNA, 20 nt, Artificial Sequence
  CXCR4 targeting guide RNA
ugacaucuuaguagauacuu

SEQ ID NO: 4456 - RNA, 20 nt, Artificial Sequence
  CXCR4 targeting guide RNA
ugucagacuuuuuucacaau

SEQ ID NO: 4457 - RNA, 20 nt, Artificial Sequence
  CXCR4 targeting guide RNA
ugugaaaaaagucugacauc

SEQ ID NO: 4458 - RNA, 20 nt, Artificial Sequence
  CXCR4 targeting guide RNA
uugugaaaaaagucugacau

SEQ ID NO: 4459 - RNA, 21 nt, Artificial Sequence
  CXCR4 targeting guide RNA
aaaagucugacaucuuaguag

SEQ ID NO: 4460 - RNA, 21 nt, Artificial Sequence
  CXCR4 targeting guide RNA
aaagucugacaucuuaguaga

SEQ ID NO: 4461 - RNA, 21 nt, Artificial Sequence
  CXCR4 targeting guide RNA
aagaugucagacuuuuuucac

SEQ ID NO: 4462 - RNA, 21 nt, Artificial Sequence
  CXCR4 targeting guide RNA
aaguaucuacuaagaugucag

SEQ ID NO: 4463 - RNA, 21 nt, Artificial Sequence
  CXCR4 targeting guide RNA
aagucugacaucuuaguagau

SEQ ID NO: 4464 - RNA, 21 nt, Artificial Sequence
  CXCR4 targeting guide RNA
agaugucagacuuuuuucaca

SEQ ID NO: 4465 - RNA, 21 nt, Artificial Sequence
  CXCR4 targeting guide RNA
aggacuauugugaaaaaaguc

SEQ ID NO: 4466 - RNA, 21 nt, Artificial Sequence
  CXCR4 targeting guide RNA
aguaucuacuaagaugucaga

SEQ ID NO: 4467 - RNA, 21 nt, Artificial Sequence
  CXCR4 targeting guide RNA
agucugacaucuuaguagaua

SEQ ID NO: 4468 - RNA, 21 nt, Artificial Sequence
  CXCR4 targeting guide RNA
aucuacuaagaugucagacuu

SEQ ID NO: 4469 - RNA, 21 nt, Artificial Sequence
  CXCR4 targeting guide RNA
cagacuuuuuucacaauaguc

SEQ ID NO: 4470 - RNA, 21 nt, Artificial Sequence
  CXCR4 targeting guide RNA
cuaagaugucagacuuuuuuc

SEQ ID NO: 4471 - RNA, 21 nt, Artificial Sequence
  CXCR4 targeting guide RNA
cuacuaagaugucagacuuuu

SEQ ID NO: 4472 - RNA, 21 nt, Artificial Sequence
  CXCR4 targeting guide RNA
cuauugugaaaaaagucugac

SEQ ID NO: 4473 - RNA, 21 nt, Artificial Sequence
  CXCR4 targeting guide RNA
cugacaucuuaguagauacuu

SEQ ID NO: 4474 - RNA, 21 nt, Artificial Sequence
  CXCR4 targeting guide RNA
gaaaaaagucugacaucuuag

SEQ ID NO: 4475 - RNA, 21 nt, Artificial Sequence
  CXCR4 targeting guide RNA
gacuauugugaaaaaagucug

SEQ ID NO: 4476 - RNA, 21 nt, Artificial Sequence
  CXCR4 targeting guide RNA
gaugucagacuuuuuucacaa

SEQ ID NO: 4477 - RNA, 21 nt, Artificial Sequence
  CXCR4 targeting guide RNA
ggacuauugugaaaaaagucu

SEQ ID NO: 4478 - RNA, 21 nt, Artificial Sequence
  CXCR4 targeting guide RNA
guaucuacuaagaugucagac

SEQ ID NO: 4479 - RNA, 21 nt, Artificial Sequence
  CXCR4 targeting guide RNA
gucagacuuuuuucacaauag

SEQ ID NO: 4480 - RNA, 21 nt, Artificial Sequence
  CXCR4 targeting guide RNA
gucugacaucuuaguagauac

SEQ ID NO: 4481 - RNA, 21 nt, Artificial Sequence
  CXCR4 targeting guide RNA
gugaaaaaagucugacaucuu

SEQ ID NO: 4482 - RNA, 21 nt, Artificial Sequence
  CXCR4 targeting guide RNA
uaucuacuaagaugucagacu

SEQ ID NO: 4483 - RNA, 21 nt, Artificial Sequence
  CXCR4 targeting guide RNA
ucuacuaagaugucagacuuu

SEQ ID NO: 4484 - RNA, 21 nt, Artificial Sequence
  CXCR4 targeting guide RNA
ucugacaucuuaguagauacu

SEQ ID NO: 4485 - RNA, 21 nt, Artificial Sequence
  CXCR4 targeting guide RNA
ugugaaaaaagucugacaucu

SEQ ID NO: 4486 - RNA, 21 nt, Artificial Sequence
  CXCR4 targeting guide RNA
uugugaaaaaagucugacauc

SEQ ID NO: 4487 - RNA, 22 nt, Artificial Sequence
  CXCR4 targeting guide RNA
aaaaagucugacaucuuaguag

SEQ ID NO: 4488 - RNA, 22 nt, Artificial Sequence
  CXCR4 targeting guide RNA
aaaagucugacaucuuaguaga

SEQ ID NO: 4489 - RNA, 22 nt, Artificial Sequence
  CXCR4 targeting guide RNA
aaaguaucuacuaagaugucag

SEQ ID NO: 4490 - RNA, 22 nt, Artificial Sequence
  CXCR4 targeting guide RNA
aaagucugacaucuuaguagau

SEQ ID NO: 4491 - RNA, 22 nt, Artificial Sequence
  CXCR4 targeting guide RNA
aagaugucagacuuuuuucaca

SEQ ID NO: 4492 - RNA, 22 nt, Artificial Sequence
  CXCR4 targeting guide RNA
aaggacuauugugaaaaaaguc

SEQ ID NO: 4493 - RNA, 22 nt, Artificial Sequence
  CXCR4 targeting guide RNA
aaguaucuacuaagaugucaga

SEQ ID NO: 4494 - RNA, 22 nt, Artificial Sequence
  CXCR4 targeting guide RNA
aagucugacaucuuaguagaua

SEQ ID NO: 4495 - RNA, 22 nt, Artificial Sequence
  CXCR4 targeting guide RNA
acuaagaugucagacuuuuuuc

SEQ ID NO: 4496 - RNA, 22 nt, Artificial Sequence
  CXCR4 targeting guide RNA
acuauugugaaaaaagucugac

SEQ ID NO: 4497 - RNA, 22 nt, Artificial Sequence
  CXCR4 targeting guide RNA
agaugucagacuuuuuucacaa

SEQ ID NO: 4498 - RNA, 22 nt, Artificial Sequence
  CXCR4 targeting guide RNA
aggacuauugugaaaaaagucu

SEQ ID NO: 4499 - RNA, 22 nt, Artificial Sequence
  CXCR4 targeting guide RNA
aguaucuacuaagaugucagac

SEQ ID NO: 4500 - RNA, 22 nt, Artificial Sequence
  CXCR4 targeting guide RNA
agucugacaucuuaguagauac

SEQ ID NO: 4501 - RNA, 22 nt, Artificial Sequence
  CXCR4 targeting guide RNA
aucuacuaagaugucagacuuu

SEQ ID NO: 4502 - RNA, 22 nt, Artificial Sequence
  CXCR4 targeting guide RNA
auugugaaaaaagucugacauc

SEQ ID NO: 4503 - RNA, 22 nt, Artificial Sequence
  CXCR4 targeting guide RNA
cagacuuuuuucacaauagucc

SEQ ID NO: 4504 - RNA, 22 nt, Artificial Sequence
  CXCR4 targeting guide RNA
cuaaaguaucuacuaagauguc

SEQ ID NO: 4505 - RNA, 22 nt, Artificial Sequence
  CXCR4 targeting guide RNA
cuaagaugucagacuuuuuuca

SEQ ID NO: 4506 - RNA, 22 nt, Artificial Sequence
  CXCR4 targeting guide RNA
cuacuaagaugucagacuuuuu

SEQ ID NO: 4507 - RNA, 22 nt, Artificial Sequence
  CXCR4 targeting guide RNA
cuauugugaaaaaagucugaca

SEQ ID NO: 4508 - RNA, 22 nt, Artificial Sequence
  CXCR4 targeting guide RNA
cugacaucuuaguagauacuuu

SEQ ID NO: 4509 - RNA, 22 nt, Artificial Sequence
  CXCR4 targeting guide RNA
gaaaaaagucugacaucuuagu

SEQ ID NO: 4510 - RNA, 22 nt, Artificial Sequence
  CXCR4 targeting guide RNA
gaaaggacuauugugaaaaaag

SEQ ID NO: 4511 - RNA, 22 nt, Artificial Sequence
  CXCR4 targeting guide RNA
gacuauugugaaaaaagucuga

SEQ ID NO: 4512 - RNA, 22 nt, Artificial Sequence
  CXCR4 targeting guide RNA
gaugucagacuuuuuucacaau

SEQ ID NO: 4513 - RNA, 22 nt, Artificial Sequence
  CXCR4 targeting guide RNA
ggacuauugugaaaaaagucug

SEQ ID NO: 4514 - RNA, 22 nt, Artificial Sequence
  CXCR4 targeting guide RNA
guaucuacuaagaugucagacu

SEQ ID NO: 4515 - RNA, 22 nt, Artificial Sequence
  CXCR4 targeting guide RNA
gucagacuuuuuucacaauagu

SEQ ID NO: 4516 - RNA, 22 nt, Artificial Sequence
  CXCR4 targeting guide RNA
gucugacaucuuaguagauacu

SEQ ID NO: 4517 - RNA, 22 nt, Artificial Sequence
  CXCR4 targeting guide RNA
gugaaaaaagucugacaucuua

SEQ ID NO: 4518 - RNA, 22 nt, Artificial Sequence
  CXCR4 targeting guide RNA
uaagaugucagacuuuuuucac

SEQ ID NO: 4519 - RNA, 22 nt, Artificial Sequence
  CXCR4 targeting guide RNA
uaucuacuaagaugucagacuu

SEQ ID NO: 4520 - RNA, 22 nt, Artificial Sequence
  CXCR4 targeting guide RNA
ucagacuuuuuucacaauaguc

SEQ ID NO: 4521 - RNA, 22 nt, Artificial Sequence
  CXCR4 targeting guide RNA
ucuacuaagaugucagacuuuu

SEQ ID NO: 4522 - RNA, 22 nt, Artificial Sequence
  CXCR4 targeting guide RNA
ucugacaucuuaguagauacuu

SEQ ID NO: 4523 - RNA, 22 nt, Artificial Sequence
  CXCR4 targeting guide RNA
ugaaaaaagucugacaucuuag

SEQ ID NO: 4524 - RNA, 22 nt, Artificial Sequence
  CXCR4 targeting guide RNA
ugucagacuuuuuucacaauag

SEQ ID NO: 4525 - RNA, 22 nt, Artificial Sequence
  CXCR4 targeting guide RNA
ugugaaaaaagucugacaucuu

SEQ ID NO: 4526 - RNA, 22 nt, Artificial Sequence
  CXCR4 targeting guide RNA
uugugaaaaaagucugacaucu

SEQ ID NO: 4527 - RNA, 20 nt, Artificial Sequence
  CXCR4 targeting guide RNA
aaaaaagucucacaucuuag

SEQ ID NO: 4528 - RNA, 20 nt, Artificial Sequence
  CXCR4 targeting guide RNA
aaaaagucucacaucuuagu

SEQ ID NO: 4529 - RNA, 20 nt, Artificial Sequence
  CXCR4 targeting guide RNA
aaaagucucacaucuuagua

SEQ ID NO: 4530 - RNA, 20 nt, Artificial Sequence
  CXCR4 targeting guide RNA
aaaguaucuacuaagaugug

SEQ ID NO: 4531 - RNA, 20 nt, Artificial Sequence
  CXCR4 targeting guide RNA
aaagucucacaucuuaguag

SEQ ID NO: 4532 - RNA, 20 nt, Artificial Sequence
  CXCR4 targeting guide RNA
aagaugugagacuuuuuuca

SEQ ID NO: 4533 - RNA, 20 nt, Artificial Sequence
  CXCR4 targeting guide RNA
aaguaucuacuaagauguga

SEQ ID NO: 4534 - RNA, 20 nt, Artificial Sequence
  CXCR4 targeting guide RNA
aagucucacaucuuaguaga

SEQ ID NO: 4535 - RNA, 20 nt, Artificial Sequence
  CXCR4 targeting guide RNA
acuaagaugugagacuuuuu

SEQ ID NO: 4536 - RNA, 20 nt, Artificial Sequence
  CXCR4 targeting guide RNA
acuauugugaaaaaagucuc

SEQ ID NO: 4537 - RNA, 20 nt, Artificial Sequence
  CXCR4 targeting guide RNA
agaugugagacuuuuuucac

SEQ ID NO: 4538 - RNA, 20 nt, Artificial Sequence
  CXCR4 targeting guide RNA
aguaucuacuaagaugugag

SEQ ID NO: 4539 - RNA, 20 nt, Artificial Sequence
  CXCR4 targeting guide RNA
agucucacaucuuaguagau

SEQ ID NO: 4540 - RNA, 20 nt, Artificial Sequence
  CXCR4 targeting guide RNA
aucuacuaagaugugagacu

SEQ ID NO: 4541 - RNA, 20 nt, Artificial Sequence
  CXCR4 targeting guide RNA
augugagacuuuuuucacaa

SEQ ID NO: 4542 - RNA, 20 nt, Artificial Sequence
  CXCR4 targeting guide RNA
auugugaaaaaagucucaca

SEQ ID NO: 4543 - RNA, 20 nt, Artificial Sequence
  CXCR4 targeting guide RNA
cuaagaugugagacuuuuuu

SEQ ID NO: 4544 - RNA, 20 nt, Artificial Sequence
  CXCR4 targeting guide RNA
cuacuaagaugugagacuuu

SEQ ID NO: 4545 - RNA, 20 nt, Artificial Sequence
  CXCR4 targeting guide RNA
cuauugugaaaaaagucuca

SEQ ID NO: 4546 - RNA, 20 nt, Artificial Sequence
  CXCR4 targeting guide RNA
cucacaucuuaguagauacu

SEQ ID NO: 4547 - RNA, 20 nt, Artificial Sequence
  CXCR4 targeting guide RNA
gaaaaaagucucacaucuua

SEQ ID NO: 4548 - RNA, 20 nt, Artificial Sequence
  CXCR4 targeting guide RNA
gagacuuuuuucacaauagu

SEQ ID NO: 4549 - RNA, 20 nt, Artificial Sequence
  CXCR4 targeting guide RNA
gaugugagacuuuuuucaca

SEQ ID NO: 4550 - RNA, 20 nt, Artificial Sequence
  CXCR4 targeting guide RNA
guaucuacuaagaugugaga

SEQ ID NO: 4551 - RNA, 20 nt, Artificial Sequence
  CXCR4 targeting guide RNA
gucucacaucuuaguagaua

SEQ ID NO: 4552 - RNA, 20 nt, Artificial Sequence
  CXCR4 targeting guide RNA
gugaaaaaagucucacaucu

SEQ ID NO: 4553 - RNA, 20 nt, Artificial Sequence
  CXCR4 targeting guide RNA
gugagacuuuuuucacaaua

SEQ ID NO: 4554 - RNA, 20 nt, Artificial Sequence
  CXCR4 targeting guide RNA
uaagaugugagacuuuuuuc

SEQ ID NO: 4555 - RNA, 20 nt, Artificial Sequence
  CXCR4 targeting guide RNA
uacuaagaugugagacuuuu

SEQ ID NO: 4556 - RNA, 20 nt, Artificial Sequence
  CXCR4 targeting guide RNA
uaucuacuaagaugugagac

SEQ ID NO: 4557 - RNA, 20 nt, Artificial Sequence
  CXCR4 targeting guide RNA
uauugugaaaaaagucucac

SEQ ID NO: 4558 - RNA, 20 nt, Artificial Sequence
  CXCR4 targeting guide RNA
ucacaucuuaguagauacuu

SEQ ID NO: 4559 - RNA, 20 nt, Artificial Sequence
  CXCR4 targeting guide RNA
ucuacuaagaugugagacuu

SEQ ID NO: 4560 - RNA, 20 nt, Artificial Sequence
  CXCR4 targeting guide RNA
ucucacaucuuaguagauac

SEQ ID NO: 4561 - RNA, 20 nt, Artificial Sequence
  CXCR4 targeting guide RNA
ugaaaaaagucucacaucuu

SEQ ID NO: 4562 - RNA, 20 nt, Artificial Sequence
  CXCR4 targeting guide RNA
ugagacuuuuuucacaauag

SEQ ID NO: 4563 - RNA, 20 nt, Artificial Sequence
  CXCR4 targeting guide RNA
ugugaaaaaagucucacauc

SEQ ID NO: 4564 - RNA, 20 nt, Artificial Sequence
  CXCR4 targeting guide RNA
ugugagacuuuuuucacaau

SEQ ID NO: 4565 - RNA, 20 nt, Artificial Sequence
  CXCR4 targeting guide RNA
uugugaaaaaagucucacau

SEQ ID NO: 4566 - RNA, 21 nt, Artificial Sequence
  CXCR4 targeting guide RNA
aaaagucucacaucuuaguag

SEQ ID NO: 4567 - RNA, 21 nt, Artificial Sequence
  CXCR4 targeting guide RNA
aaagucucacaucuuaguaga

SEQ ID NO: 4568 - RNA, 21 nt, Artificial Sequence
  CXCR4 targeting guide RNA
aagaugugagacuuuuuucac

SEQ ID NO: 4569 - RNA, 21 nt, Artificial Sequence
  CXCR4 targeting guide RNA
aaguaucuacuaagaugugag

SEQ ID NO: 4570 - RNA, 21 nt, Artificial Sequence
  CXCR4 targeting guide RNA
aagucucacaucuuaguagau

SEQ ID NO: 4571 - RNA, 21 nt, Artificial Sequence
  CXCR4 targeting guide RNA
agaugugagacuuuuuucaca

SEQ ID NO: 4572 - RNA, 21 nt, Artificial Sequence
  CXCR4 targeting guide RNA
aguaucuacuaagaugugaga

SEQ ID NO: 4573 - RNA, 21 nt, Artificial Sequence
  CXCR4 targeting guide RNA
agucucacaucuuaguagaua

SEQ ID NO: 4574 - RNA, 21 nt, Artificial Sequence
  CXCR4 targeting guide RNA
aucuacuaagaugugagacuu

SEQ ID NO: 4575 - RNA, 21 nt, Artificial Sequence
  CXCR4 targeting guide RNA
cuaagaugugagacuuuuuuc

SEQ ID NO: 4576 - RNA, 21 nt, Artificial Sequence
  CXCR4 targeting guide RNA
cuacuaagaugugagacuuuu

SEQ ID NO: 4577 - RNA, 21 nt, Artificial Sequence
  CXCR4 targeting guide RNA
cuauugugaaaaaagucucac

SEQ ID NO: 4578 - RNA, 21 nt, Artificial Sequence
  CXCR4 targeting guide RNA
cucacaucuuaguagauacuu

SEQ ID NO: 4579 - RNA, 21 nt, Artificial Sequence
  CXCR4 targeting guide RNA
gaaaaaagucucacaucuuag

SEQ ID NO: 4580 - RNA, 21 nt, Artificial Sequence
  CXCR4 targeting guide RNA
gacuauugugaaaaaagucuc

SEQ ID NO: 4581 - RNA, 21 nt, Artificial Sequence
  CXCR4 targeting guide RNA
gagacuuuuuucacaauaguc

SEQ ID NO: 4582 - RNA, 21 nt, Artificial Sequence
  CXCR4 targeting guide RNA
gaugugagacuuuuuucacaa

SEQ ID NO: 4583 - RNA, 21 nt, Artificial Sequence
  CXCR4 targeting guide RNA
guaucuacuaagaugugagac

SEQ ID NO: 4584 - RNA, 21 nt, Artificial Sequence
  CXCR4 targeting guide RNA
gucucacaucuuaguagauac

SEQ ID NO: 4585 - RNA, 21 nt, Artificial Sequence
  CXCR4 targeting guide RNA
gugaaaaaagucucacaucuu

SEQ ID NO: 4586 - RNA, 21 nt, Artificial Sequence
  CXCR4 targeting guide RNA
gugagacuuuuuucacaauag

SEQ ID NO: 4587 - RNA, 21 nt, Artificial Sequence
  CXCR4 targeting guide RNA
uaucuacuaagaugugagacu

SEQ ID NO: 4588 - RNA, 21 nt, Artificial Sequence
  CXCR4 targeting guide RNA
ucuacuaagaugugagacuuu

SEQ ID NO: 4589 - RNA, 21 nt, Artificial Sequence
  CXCR4 targeting guide RNA
ucucacaucuuaguagauacu

SEQ ID NO: 4590 - RNA, 21 nt, Artificial Sequence
  CXCR4 targeting guide RNA
ugugaaaaaagucucacaucu

SEQ ID NO: 4591 - RNA, 21 nt, Artificial Sequence
  CXCR4 targeting guide RNA
uugugaaaaaagucucacauc

SEQ ID NO: 4592 - RNA, 22 nt, Artificial Sequence
  CXCR4 targeting guide RNA
aaaaagucucacaucuuaguag

SEQ ID NO: 4593 - RNA, 22 nt, Artificial Sequence
  CXCR4 targeting guide RNA
aaaagucucacaucuuaguaga

SEQ ID NO: 4594 - RNA, 22 nt, Artificial Sequence
  CXCR4 targeting guide RNA
aaaguaucuacuaagaugugag

SEQ ID NO: 4595 - RNA, 22 nt, Artificial Sequence
  CXCR4 targeting guide RNA
aaagucucacaucuuaguagau

SEQ ID NO: 4596 - RNA, 22 nt, Artificial Sequence
  CXCR4 targeting guide RNA
aagaugugagacuuuuuucaca

SEQ ID NO: 4597 - RNA, 22 nt, Artificial Sequence
  CXCR4 targeting guide RNA
aaguaucuacuaagaugugaga

SEQ ID NO: 4598 - RNA, 22 nt, Artificial Sequence
  CXCR4 targeting guide RNA
aagucucacaucuuaguagaua

SEQ ID NO: 4599 - RNA, 22 nt, Artificial Sequence
  CXCR4 targeting guide RNA
acuaagaugugagacuuuuuuc

SEQ ID NO: 4600 - RNA, 22 nt, Artificial Sequence
  CXCR4 targeting guide RNA
acuauugugaaaaaagucucac

SEQ ID NO: 4601 - RNA, 22 nt, Artificial Sequence
  CXCR4 targeting guide RNA
agaugugagacuuuuuucacaa

SEQ ID NO: 4602 - RNA, 22 nt, Artificial Sequence
  CXCR4 targeting guide RNA
aguaucuacuaagaugugagac

SEQ ID NO: 4603 - RNA, 22 nt, Artificial Sequence
  CXCR4 targeting guide RNA
agucucacaucuuaguagauac

SEQ ID NO: 4604 - RNA, 22 nt, Artificial Sequence
  CXCR4 targeting guide RNA
aucuacuaagaugugagacuuu

SEQ ID NO: 4605 - RNA, 22 nt, Artificial Sequence
  CXCR4 targeting guide RNA
auugugaaaaaagucucacauc

SEQ ID NO: 4606 - RNA, 22 nt, Artificial Sequence
  CXCR4 targeting guide RNA
cuaaaguaucuacuaagaugug

SEQ ID NO: 4607 - RNA, 22 nt, Artificial Sequence
  CXCR4 targeting guide RNA
cuaagaugugagacuuuuuuca

SEQ ID NO: 4608 - RNA, 22 nt, Artificial Sequence
  CXCR4 targeting guide RNA
cuacuaagaugugagacuuuuu

SEQ ID NO: 4609 - RNA, 22 nt, Artificial Sequence
  CXCR4 targeting guide RNA
cuauugugaaaaaagucucaca

SEQ ID NO: 4610 - RNA, 22 nt, Artificial Sequence
  CXCR4 targeting guide RNA
cucacaucuuaguagauacuuu

SEQ ID NO: 4611 - RNA, 22 nt, Artificial Sequence
  CXCR4 targeting guide RNA
gaaaaaagucucacaucuuagu

SEQ ID NO: 4612 - RNA, 22 nt, Artificial Sequence
  CXCR4 targeting guide RNA
gacuauugugaaaaaagucuca

SEQ ID NO: 4613 - RNA, 22 nt, Artificial Sequence
  CXCR4 targeting guide RNA
gagacuuuuuucacaauagucc

SEQ ID NO: 4614 - RNA, 22 nt, Artificial Sequence
  CXCR4 targeting guide RNA
gaugugagacuuuuuucacaau

SEQ ID NO: 4615 - RNA, 22 nt, Artificial Sequence
  CXCR4 targeting guide RNA
ggacuauugugaaaaaagucuc

SEQ ID NO: 4616 - RNA, 22 nt, Artificial Sequence
  CXCR4 targeting guide RNA
guaucuacuaagaugugagacu

SEQ ID NO: 4617 - RNA, 22 nt, Artificial Sequence
  CXCR4 targeting guide RNA
gucucacaucuuaguagauacu

SEQ ID NO: 4618 - RNA, 22 nt, Artificial Sequence
  CXCR4 targeting guide RNA
gugaaaaaagucucacaucuua

SEQ ID NO: 4619 - RNA, 22 nt, Artificial Sequence
  CXCR4 targeting guide RNA
gugagacuuuuuucacaauagu

SEQ ID NO: 4620 - RNA, 22 nt, Artificial Sequence
  CXCR4 targeting guide RNA
uaagaugugagacuuuuuucac

SEQ ID NO: 4621 - RNA, 22 nt, Artificial Sequence
  CXCR4 targeting guide RNA
uaucuacuaagaugugagacuu

SEQ ID NO: 4622 - RNA, 22 nt, Artificial Sequence
  CXCR4 targeting guide RNA
ucuacuaagaugugagacuuuu

SEQ ID NO: 4623 - RNA, 22 nt, Artificial Sequence
  CXCR4 targeting guide RNA
ucucacaucuuaguagauacuu

SEQ ID NO: 4624 - RNA, 22 nt, Artificial Sequence
  CXCR4 targeting guide RNA
ugaaaaaagucucacaucuuag

SEQ ID NO: 4625 - RNA, 22 nt, Artificial Sequence
  CXCR4 targeting guide RNA
ugagacuuuuuucacaauaguc

SEQ ID NO: 4626 - RNA, 22 nt, Artificial Sequence
  CXCR4 targeting guide RNA
ugugaaaaaagucucacaucuu

SEQ ID NO: 4627 - RNA, 22 nt, Artificial Sequence
  CXCR4 targeting guide RNA
ugugagacuuuuuucacaauag

SEQ ID NO: 4628 - RNA, 22 nt, Artificial Sequence
  CXCR4 targeting guide RNA
uugugaaaaaagucucacaucu

SEQ ID NO: 4629 - RNA, 20 nt, Artificial Sequence
  CXCR4 targeting guide RNA
aaaaaccagcauuucuauac

SEQ ID NO: 4630 - RNA, 20 nt, Artificial Sequence
  CXCR4 targeting guide RNA
aaaaacguuccacgggaaug

SEQ ID NO: 4631 - RNA, 20 nt, Artificial Sequence
  CXCR4 targeting guide RNA
aaaaccagcauuucuauacc

SEQ ID NO: 4632 - RNA, 20 nt, Artificial Sequence
  CXCR4 targeting guide RNA
aaaacguuccacgggaaugg

SEQ ID NO: 4633 - RNA, 20 nt, Artificial Sequence
  CXCR4 targeting guide RNA
aaaacugaaaaaccagcauu

SEQ ID NO: 4634 - RNA, 20 nt, Artificial Sequence
  CXCR4 targeting guide RNA
aaaacuguacaauauugguc

SEQ ID NO: 4635 - RNA, 20 nt, Artificial Sequence
  CXCR4 targeting guide RNA
aaaagacugaccaauauugu

SEQ ID NO: 4636 - RNA, 20 nt, Artificial Sequence
  CXCR4 targeting guide RNA
aaaagggaacugaacauucc

SEQ ID NO: 4637 - RNA, 20 nt, Artificial Sequence
  CXCR4 targeting guide RNA
aaaaucacgucuuaagaaca

SEQ ID NO: 4638 - RNA, 20 nt, Artificial Sequence
  CXCR4 targeting guide RNA
aaacacaagacaaaaaucca

SEQ ID NO: 4639 - RNA, 20 nt, Artificial Sequence
  CXCR4 targeting guide RNA
aaacagcuggggaucauuuc

SEQ ID NO: 4640 - RNA, 20 nt, Artificial Sequence
  CXCR4 targeting guide RNA
aaaccagcauuucuauacca

SEQ ID NO: 4641 - RNA, 20 nt, Artificial Sequence
  CXCR4 targeting guide RNA
aaacguuccacgggaaugga

SEQ ID NO: 4642 - RNA, 20 nt, Artificial Sequence
  CXCR4 targeting guide RNA
aaacuaaagaaacacaagac

SEQ ID NO: 4643 - RNA, 20 nt, Artificial Sequence
  CXCR4 targeting guide RNA
aaacugaaaaaccagcauuu

SEQ ID NO: 4644 - RNA, 20 nt, Artificial Sequence
  CXCR4 targeting guide RNA
aaacuguacaauauugguca

SEQ ID NO: 4645 - RNA, 20 nt, Artificial Sequence
  CXCR4 targeting guide RNA
aaagacugaccaauauugua

SEQ ID NO: 4646 - RNA, 20 nt, Artificial Sequence
  CXCR4 targeting guide RNA
aaagcccaaagugguauaga

SEQ ID NO: 4647 - RNA, 20 nt, Artificial Sequence
  CXCR4 targeting guide RNA
aaagcuagaaaugaucccca

SEQ ID NO: 4648 - RNA, 20 nt, Artificial Sequence
  CXCR4 targeting guide RNA
aaagggaacugaacauucca

SEQ ID NO: 4649 - RNA, 20 nt, Artificial Sequence
  CXCR4 targeting guide RNA
aaagugguauagaaaugcug

SEQ ID NO: 4650 - RNA, 20 nt, Artificial Sequence
  CXCR4 targeting guide RNA
aaaucaacccacuccugaaa

SEQ ID NO: 4651 - RNA, 20 nt, Artificial Sequence
  CXCR4 targeting guide RNA
aaaucacgucuuaagaacag

SEQ ID NO: 4652 - RNA, 20 nt, Artificial Sequence
  CXCR4 targeting guide RNA
aaaugauccccagcuguuua

SEQ ID NO: 4653 - RNA, 20 nt, Artificial Sequence
  CXCR4 targeting guide RNA
aaaugcugguuuuucaguuu

SEQ ID NO: 4654 - RNA, 20 nt, Artificial Sequence
  CXCR4 targeting guide RNA
aacaacuuaauacaagacug

SEQ ID NO: 4655 - RNA, 20 nt, Artificial Sequence
  CXCR4 targeting guide RNA
aacacaagacaaaaauccaa

SEQ ID NO: 4656 - RNA, 20 nt, Artificial Sequence
  CXCR4 targeting guide RNA
aacagcuggggaucauuucu

SEQ ID NO: 4657 - RNA, 20 nt, Artificial Sequence
  CXCR4 targeting guide RNA
aacaggaaaaacguuccacg

SEQ ID NO: 4658 - RNA, 20 nt, Artificial Sequence
  CXCR4 targeting guide RNA
aacauuccagagcguguagu

SEQ ID NO: 4659 - RNA, 20 nt, Artificial Sequence
  CXCR4 targeting guide RNA
aaccaaagcccaaaguggua

SEQ ID NO: 4660 - RNA, 20 nt, Artificial Sequence
  CXCR4 targeting guide RNA
aaccagcauuucuauaccac

SEQ ID NO: 4661 - RNA, 20 nt, Artificial Sequence
  CXCR4 targeting guide RNA
aacccacuccugaaaacuga

SEQ ID NO: 4662 - RNA, 20 nt, Artificial Sequence
  CXCR4 targeting guide RNA
aacguuccacgggaauggag

SEQ ID NO: 4663 - RNA, 20 nt, Artificial Sequence
  CXCR4 targeting guide RNA
aacguuuuuccuguucuuaa

SEQ ID NO: 4664 - RNA, 20 nt, Artificial Sequence
  CXCR4 targeting guide RNA
aacuaaagaaacacaagaca

SEQ ID NO: 4665 - RNA, 20 nt, Artificial Sequence
  CXCR4 targeting guide RNA
aacuaagaacuuggccacag

SEQ ID NO: 4666 - RNA, 20 nt, Artificial Sequence
  CXCR4 targeting guide RNA
aacugaaaaaccagcauuuc

SEQ ID NO: 4667 - RNA, 20 nt, Artificial Sequence
  CXCR4 targeting guide RNA
aacugaacauuccagagcgu

SEQ ID NO: 4668 - RNA, 20 nt, Artificial Sequence
  CXCR4 targeting guide RNA
aacuguacaauauuggucag

SEQ ID NO: 4669 - RNA, 20 nt, Artificial Sequence
  CXCR4 targeting guide RNA
aacuuaauacaagacuguac

SEQ ID NO: 4670 - RNA, 20 nt, Artificial Sequence
  CXCR4 targeting guide RNA
aacuuggccacagguccugc

SEQ ID NO: 4671 - RNA, 20 nt, Artificial Sequence
  CXCR4 targeting guide RNA
aagaacaggaaaaacguucc

SEQ ID NO: 4672 - RNA, 20 nt, Artificial Sequence
  CXCR4 targeting guide RNA
aagaacuuggccacaggucc

SEQ ID NO: 4673 - RNA, 20 nt, Artificial Sequence
  CXCR4 targeting guide RNA
aagacaaaaauccaacaagc

SEQ ID NO: 4674 - RNA, 20 nt, Artificial Sequence
  CXCR4 targeting guide RNA
aagacgugauuuugcuguag

SEQ ID NO: 4675 - RNA, 20 nt, Artificial Sequence
  CXCR4 targeting guide RNA
aagacugaccaauauuguac

SEQ ID NO: 4676 - RNA, 20 nt, Artificial Sequence
  CXCR4 targeting guide RNA
aagacuguacacuguaggug

SEQ ID NO: 4677 - RNA, 20 nt, Artificial Sequence
  CXCR4 targeting guide RNA
aagauggcacuuauaaccaa

SEQ ID NO: 4678 - RNA, 20 nt, Artificial Sequence
  CXCR4 targeting guide RNA
aagcccaaagugguauagaa

SEQ ID NO: 4679 - RNA, 20 nt, Artificial Sequence
  CXCR4 targeting guide RNA
aagcuagaaaugauccccag

SEQ ID NO: 4680 - RNA, 20 nt, Artificial Sequence
  CXCR4 targeting guide RNA
aagggaacugaacauuccag

SEQ ID NO: 4681 - RNA, 20 nt, Artificial Sequence
  CXCR4 targeting guide RNA
aagugccaucuucuacagca

SEQ ID NO: 4682 - RNA, 20 nt, Artificial Sequence
  CXCR4 targeting guide RNA
aagugguauagaaaugcugg

SEQ ID NO: 4683 - RNA, 20 nt, Artificial Sequence
  CXCR4 targeting guide RNA
aaguucuuaguugcuguaug

SEQ ID NO: 4684 - RNA, 20 nt, Artificial Sequence
  CXCR4 targeting guide RNA
aauacaagacuguacacugu

SEQ ID NO: 4685 - RNA, 20 nt, Artificial Sequence
  CXCR4 targeting guide RNA
aaucaacccacuccugaaaa

SEQ ID NO: 4686 - RNA, 20 nt, Artificial Sequence
  CXCR4 targeting guide RNA
aaucacguaaagcuagaaau

SEQ ID NO: 4687 - RNA, 20 nt, Artificial Sequence
  CXCR4 targeting guide RNA
aaucacgucuuaagaacagg

SEQ ID NO: 4688 - RNA, 20 nt, Artificial Sequence
  CXCR4 targeting guide RNA
aaucucuccauucccgugga

SEQ ID NO: 4689 - RNA, 20 nt, Artificial Sequence
  CXCR4 targeting guide RNA
aaugauccccagcuguuuau

SEQ ID NO: 4690 - RNA, 20 nt, Artificial Sequence
  CXCR4 targeting guide RNA
aaugcugguuuuucaguuuu

SEQ ID NO: 4691 - RNA, 20 nt, Artificial Sequence
  CXCR4 targeting guide RNA
aauggagagauuaucuaugc

SEQ ID NO: 4692 - RNA, 20 nt, Artificial Sequence
  CXCR4 targeting guide RNA
aauguucaguucccuuuucu

SEQ ID NO: 4693 - RNA, 20 nt, Artificial Sequence
  CXCR4 targeting guide RNA
acaaaaauccaacaagcaau

SEQ ID NO: 4694 - RNA, 20 nt, Artificial Sequence
  CXCR4 targeting guide RNA
acaacuuaauacaagacugu

SEQ ID NO: 4695 - RNA, 20 nt, Artificial Sequence
  CXCR4 targeting guide RNA
acaagacaaaaauccaacaa

SEQ ID NO: 4696 - RNA, 20 nt, Artificial Sequence
  CXCR4 targeting guide RNA
acaagacuguacacuguagg

SEQ ID NO: 4697 - RNA, 20 nt, Artificial Sequence
  CXCR4 targeting guide RNA
acaagcaauaaaaacuguac

SEQ ID NO: 4698 - RNA, 20 nt, Artificial Sequence
  CXCR4 targeting guide RNA
acaauauuggucagucuuuu

SEQ ID NO: 4699 - RNA, 20 nt, Artificial Sequence
  CXCR4 targeting guide RNA
acacaagacaaaaauccaac

SEQ ID NO: 4700 - RNA, 20 nt, Artificial Sequence
  CXCR4 targeting guide RNA
acacacaucaauaugaaaca

SEQ ID NO: 4701 - RNA, 20 nt, Artificial Sequence
  CXCR4 targeting guide RNA
acacgcucuggaauguucag

SEQ ID NO: 4702 - RNA, 20 nt, Artificial Sequence
  CXCR4 targeting guide RNA
acacuguaggugcugaaauc

SEQ ID NO: 4703 - RNA, 20 nt, Artificial Sequence
  CXCR4 targeting guide RNA
acagcaaaaucacgucuuaa

SEQ ID NO: 4704 - RNA, 20 nt, Artificial Sequence
  CXCR4 targeting guide RNA
acagcaacuaagaacuuggc

SEQ ID NO: 4705 - RNA, 20 nt, Artificial Sequence
  CXCR4 targeting guide RNA
acagcuggggaucauuucua

SEQ ID NO: 4706 - RNA, 20 nt, Artificial Sequence
  CXCR4 targeting guide RNA
acaggaaaaacguuccacgg

SEQ ID NO: 4707 - RNA, 20 nt, Artificial Sequence
  CXCR4 targeting guide RNA
acagguccugccuagacaca

SEQ ID NO: 4708 - RNA, 20 nt, Artificial Sequence
  CXCR4 targeting guide RNA
acaguccuaccacgagacau

SEQ ID NO: 4709 - RNA, 20 nt, Artificial Sequence
  CXCR4 targeting guide RNA
acagucuuguauuaaguugu

SEQ ID NO: 4710 - RNA, 20 nt, Artificial Sequence
  CXCR4 targeting guide RNA
acaguguacagucuuguauu

SEQ ID NO: 4711 - RNA, 20 nt, Artificial Sequence
  CXCR4 targeting guide RNA
acaguuuuuauugcuuguug

SEQ ID NO: 4712 - RNA, 20 nt, Artificial Sequence
  CXCR4 targeting guide RNA
acauacagcaacuaagaacu

SEQ ID NO: 4713 - RNA, 20 nt, Artificial Sequence
  CXCR4 targeting guide RNA
acauuccagagcguguagug

SEQ ID NO: 4714 - RNA, 20 nt, Artificial Sequence
  CXCR4 targeting guide RNA
accaaagcccaaagugguau

SEQ ID NO: 4715 - RNA, 20 nt, Artificial Sequence
  CXCR4 targeting guide RNA
accacgagacauacagcaac

SEQ ID NO: 4716 - RNA, 20 nt, Artificial Sequence
  CXCR4 targeting guide RNA
accacuuugggcuuugguua

SEQ ID NO: 4717 - RNA, 20 nt, Artificial Sequence
  CXCR4 targeting guide RNA
accagcauuucuauaccacu

SEQ ID NO: 4718 - RNA, 20 nt, Artificial Sequence
  CXCR4 targeting guide RNA
acccacuccugaaaacugaa

SEQ ID NO: 4719 - RNA, 20 nt, Artificial Sequence
  CXCR4 targeting guide RNA
accuacaguguacagucuug

SEQ ID NO: 4720 - RNA, 20 nt, Artificial Sequence
  CXCR4 targeting guide RNA
accuguggccaaguucuuag

SEQ ID NO: 4721 - RNA, 20 nt, Artificial Sequence
  CXCR4 targeting guide RNA
acgagacauacagcaacuaa

SEQ ID NO: 4722 - RNA, 20 nt, Artificial Sequence
  CXCR4 targeting guide RNA
acgcucuggaauguucaguu

SEQ ID NO: 4723 - RNA, 20 nt, Artificial Sequence
  CXCR4 targeting guide RNA
acgggaauggagagauuauc

SEQ ID NO: 4724 - RNA, 20 nt, Artificial Sequence
  CXCR4 targeting guide RNA
acguaaagcuagaaaugauc

SEQ ID NO: 4725 - RNA, 20 nt, Artificial Sequence
  CXCR4 targeting guide RNA
acgucuuaagaacaggaaaa

SEQ ID NO: 4726 - RNA, 20 nt, Artificial Sequence
  CXCR4 targeting guide RNA
acgugauucacuacacgcuc

SEQ ID NO: 4727 - RNA, 20 nt, Artificial Sequence
  CXCR4 targeting guide RNA
acgugauuuugcuguagaag

SEQ ID NO: 4728 - RNA, 20 nt, Artificial Sequence
  CXCR4 targeting guide RNA
acguuccacgggaauggaga

SEQ ID NO: 4729 - RNA, 20 nt, Artificial Sequence
  CXCR4 targeting guide RNA
acguuuuuccuguucuuaag

SEQ ID NO: 4730 - RNA, 20 nt, Artificial Sequence
  CXCR4 targeting guide RNA
acuaaagaaacacaagacaa

SEQ ID NO: 4731 - RNA, 20 nt, Artificial Sequence
  CXCR4 targeting guide RNA
acuaagaacuuggccacagg

SEQ ID NO: 4732 - RNA, 20 nt, Artificial Sequence
  CXCR4 targeting guide RNA
acuacacgcucuggaauguu

SEQ ID NO: 4733 - RNA, 20 nt, Artificial Sequence
  CXCR4 targeting guide RNA
acuccugaaaacugaaaaac

SEQ ID NO: 4734 - RNA, 20 nt, Artificial Sequence
  CXCR4 targeting guide RNA
acugaaaaaccagcauuucu

SEQ ID NO: 4735 - RNA, 20 nt, Artificial Sequence
  CXCR4 targeting guide RNA
acugaacauuccagagcgug

SEQ ID NO: 4736 - RNA, 20 nt, Artificial Sequence
  CXCR4 targeting guide RNA
acugaccaauauuguacagu

SEQ ID NO: 4737 - RNA, 20 nt, Artificial Sequence
  CXCR4 targeting guide RNA
acuguacaauauuggucagu

SEQ ID NO: 4738 - RNA, 20 nt, Artificial Sequence
  CXCR4 targeting guide RNA
acuguacacuguaggugcug

SEQ ID NO: 4739 - RNA, 20 nt, Artificial Sequence
  CXCR4 targeting guide RNA
acuguagaaaagggaacuga

SEQ ID NO: 4740 - RNA, 20 nt, Artificial Sequence
  CXCR4 targeting guide RNA
acuguaggugcugaaaucaa

SEQ ID NO: 4741 - RNA, 20 nt, Artificial Sequence
  CXCR4 targeting guide RNA
acuuaauacaagacuguaca

SEQ ID NO: 4742 - RNA, 20 nt, Artificial Sequence
  CXCR4 targeting guide RNA
acuuauaaccaaagcccaaa

SEQ ID NO: 4743 - RNA, 20 nt, Artificial Sequence
  CXCR4 targeting guide RNA
acuuggccacagguccugcc

SEQ ID NO: 4744 - RNA, 20 nt, Artificial Sequence
  CXCR4 targeting guide RNA
acuuugggcuuugguuauaa

SEQ ID NO: 4745 - RNA, 20 nt, Artificial Sequence
  CXCR4 targeting guide RNA
agaaaagggaacugaacauu

SEQ ID NO: 4746 - RNA, 20 nt, Artificial Sequence
  CXCR4 targeting guide RNA
agaaacacaagacaaaaauc

SEQ ID NO: 4747 - RNA, 20 nt, Artificial Sequence
  CXCR4 targeting guide RNA
agaaaugauccccagcuguu

SEQ ID NO: 4748 - RNA, 20 nt, Artificial Sequence
  CXCR4 targeting guide RNA
agaaaugcugguuuuucagu

SEQ ID NO: 4749 - RNA, 20 nt, Artificial Sequence
  CXCR4 targeting guide RNA
agaacaggaaaaacguucca

SEQ ID NO: 4750 - RNA, 20 nt, Artificial Sequence
  CXCR4 targeting guide RNA
agaacuuggccacagguccu

SEQ ID NO: 4751 - RNA, 20 nt, Artificial Sequence
  CXCR4 targeting guide RNA
agaagauggcacuuauaacc

SEQ ID NO: 4752 - RNA, 20 nt, Artificial Sequence
  CXCR4 targeting guide RNA
agacaaaaauccaacaagca

SEQ ID NO: 4753 - RNA, 20 nt, Artificial Sequence
  CXCR4 targeting guide RNA
agacacacaucaauaugaaa

SEQ ID NO: 4754 - RNA, 20 nt, Artificial Sequence
  CXCR4 targeting guide RNA
agacauacagcaacuaagaa

SEQ ID NO: 4755 - RNA, 20 nt, Artificial Sequence
  CXCR4 targeting guide RNA
agacgugauuuugcuguaga

SEQ ID NO: 4756 - RNA, 20 nt, Artificial Sequence
  CXCR4 targeting guide RNA
agacugaccaauauuguaca

SEQ ID NO: 4757 - RNA, 20 nt, Artificial Sequence
  CXCR4 targeting guide RNA
agacuguacacuguaggugc

SEQ ID NO: 4758 - RNA, 20 nt, Artificial Sequence
  CXCR4 targeting guide RNA
agagcguguagugaaucacg

SEQ ID NO: 4759 - RNA, 20 nt, Artificial Sequence
  CXCR4 targeting guide RNA
agauaaucucuccauucccg

SEQ ID NO: 4760 - RNA, 20 nt, Artificial Sequence
  CXCR4 targeting guide RNA
agauauaaaagacugaccaa

SEQ ID NO: 4761 - RNA, 20 nt, Artificial Sequence
  CXCR4 targeting guide RNA
agauggcacuuauaaccaaa

SEQ ID NO: 4762 - RNA, 20 nt, Artificial Sequence
  CXCR4 targeting guide RNA
agcaaaaucacgucuuaaga

SEQ ID NO: 4763 - RNA, 20 nt, Artificial Sequence
  CXCR4 targeting guide RNA
agcaacuaagaacuuggcca

SEQ ID NO: 4764 - RNA, 20 nt, Artificial Sequence
  CXCR4 targeting guide RNA
agcaccuacaguguacaguc

SEQ ID NO: 4765 - RNA, 20 nt, Artificial Sequence
  CXCR4 targeting guide RNA
agcauuucuauaccacuuug

SEQ ID NO: 4766 - RNA, 20 nt, Artificial Sequence
  CXCR4 targeting guide RNA
agcccaaagugguauagaaa

SEQ ID NO: 4767 - RNA, 20 nt, Artificial Sequence
  CXCR4 targeting guide RNA
agcguguagugaaucacgua

SEQ ID NO: 4768 - RNA, 20 nt, Artificial Sequence
  CXCR4 targeting guide RNA
agcuagaaaugauccccagc

SEQ ID NO: 4769 - RNA, 20 nt, Artificial Sequence
  CXCR4 targeting guide RNA
agcuggggaucauuucuagc

SEQ ID NO: 4770 - RNA, 20 nt, Artificial Sequence
  CXCR4 targeting guide RNA
agcuguuuaugcauagauaa

SEQ ID NO: 4771 - RNA, 20 nt, Artificial Sequence
  CXCR4 targeting guide RNA
agcuuuacgugauucacuac

SEQ ID NO: 4772 - RNA, 20 nt, Artificial Sequence
  CXCR4 targeting guide RNA
aggaaaaacguuccacggga

SEQ ID NO: 4773 - RNA, 20 nt, Artificial Sequence
  CXCR4 targeting guide RNA
aggaccuguggccaaguucu

SEQ ID NO: 4774 - RNA, 20 nt, Artificial Sequence
  CXCR4 targeting guide RNA
aggacuguagaaaagggaac

SEQ ID NO: 4775 - RNA, 20 nt, Artificial Sequence
  CXCR4 targeting guide RNA
aggaguggguugauuucagc

SEQ ID NO: 4776 - RNA, 20 nt, Artificial Sequence
  CXCR4 targeting guide RNA
aggcaggaccuguggccaag

SEQ ID NO: 4777 - RNA, 20 nt, Artificial Sequence
  CXCR4 targeting guide RNA
agggaacugaacauuccaga

SEQ ID NO: 4778 - RNA, 20 nt, Artificial Sequence
  CXCR4 targeting guide RNA
agguccugccuagacacaca

SEQ ID NO: 4779 - RNA, 20 nt, Artificial Sequence
  CXCR4 targeting guide RNA
aggugcugaaaucaacccac

SEQ ID NO: 4780 - RNA, 20 nt, Artificial Sequence
  CXCR4 targeting guide RNA
aguccuaccacgagacauac

SEQ ID NO: 4781 - RNA, 20 nt, Artificial Sequence
  CXCR4 targeting guide RNA
agugaaucacguaaagcuag

SEQ ID NO: 4782 - RNA, 20 nt, Artificial Sequence
  CXCR4 targeting guide RNA
agugccaucuucuacagcaa

SEQ ID NO: 4783 - RNA, 20 nt, Artificial Sequence
  CXCR4 targeting guide RNA
aguggguugauuucagcacc

SEQ ID NO: 4784 - RNA, 20 nt, Artificial Sequence
  CXCR4 targeting guide RNA
agugguauagaaaugcuggu

SEQ ID NO: 4785 - RNA, 20 nt, Artificial Sequence
  CXCR4 targeting guide RNA
aguguacagucuuguauuaa

SEQ ID NO: 4786 - RNA, 20 nt, Artificial Sequence
  CXCR4 targeting guide RNA
aguucccuuuucuacagucc

SEQ ID NO: 4787 - RNA, 20 nt, Artificial Sequence
  CXCR4 targeting guide RNA
aguucuuaguugcuguaugu

SEQ ID NO: 4788 - RNA, 20 nt, Artificial Sequence
  CXCR4 targeting guide RNA
aguugcuguaugucucgugg

SEQ ID NO: 4789 - RNA, 20 nt, Artificial Sequence
  CXCR4 targeting guide RNA
aguuuucaggaguggguuga

SEQ ID NO: 4790 - RNA, 20 nt, Artificial Sequence
  CXCR4 targeting guide RNA
aguuuuuauugcuuguugga

SEQ ID NO: 4791 - RNA, 20 nt, Artificial Sequence
  CXCR4 targeting guide RNA
auaaacagcuggggaucauu

SEQ ID NO: 4792 - RNA, 20 nt, Artificial Sequence
  CXCR4 targeting guide RNA
auaaccaaagcccaaagugg

SEQ ID NO: 4793 - RNA, 20 nt, Artificial Sequence
  CXCR4 targeting guide RNA
auaagugccaucuucuacag

SEQ ID NO: 4794 - RNA, 20 nt, Artificial Sequence
  CXCR4 targeting guide RNA
auaaucucuccauucccgug

SEQ ID NO: 4795 - RNA, 20 nt, Artificial Sequence
  CXCR4 targeting guide RNA
auacaagacuguacacugua

SEQ ID NO: 4796 - RNA, 20 nt, Artificial Sequence
  CXCR4 targeting guide RNA
auacagcaacuaagaacuug

SEQ ID NO: 4797 - RNA, 20 nt, Artificial Sequence
  CXCR4 targeting guide RNA
auaccacuuugggcuuuggu

SEQ ID NO: 4798 - RNA, 20 nt, Artificial Sequence
  CXCR4 targeting guide RNA
auagaaaugcugguuuuuca

SEQ ID NO: 4799 - RNA, 20 nt, Artificial Sequence
  CXCR4 targeting guide RNA
auagauaaucucuccauucc

SEQ ID NO: 4800 - RNA, 20 nt, Artificial Sequence
  CXCR4 targeting guide RNA
auauugaugugugucuaggc

SEQ ID NO: 4801 - RNA, 20 nt, Artificial Sequence
  CXCR4 targeting guide RNA
aucaacccacuccugaaaac

SEQ ID NO: 4802 - RNA, 20 nt, Artificial Sequence
  CXCR4 targeting guide RNA
aucacguaaagcuagaaaug

SEQ ID NO: 4803 - RNA, 20 nt, Artificial Sequence
  CXCR4 targeting guide RNA
aucacgucuuaagaacagga

SEQ ID NO: 4804 - RNA, 20 nt, Artificial Sequence
  CXCR4 targeting guide RNA
aucauuucuagcuuuacgug

SEQ ID NO: 4805 - RNA, 20 nt, Artificial Sequence
  CXCR4 targeting guide RNA
auccaacaagcaauaaaaac

SEQ ID NO: 4806 - RNA, 20 nt, Artificial Sequence
  CXCR4 targeting guide RNA
auccccagcuguuuaugcau

SEQ ID NO: 4807 - RNA, 20 nt, Artificial Sequence
  CXCR4 targeting guide RNA
aucuaugcauaaacagcugg

SEQ ID NO: 4808 - RNA, 20 nt, Artificial Sequence
  CXCR4 targeting guide RNA
aucucuccauucccguggaa

SEQ ID NO: 4809 - RNA, 20 nt, Artificial Sequence
  CXCR4 targeting guide RNA
aucuucuacagcaaaaucac

SEQ ID NO: 4810 - RNA, 20 nt, Artificial Sequence
  CXCR4 targeting guide RNA
augauccccagcuguuuaug

SEQ ID NO: 4811 - RNA, 20 nt, Artificial Sequence
  CXCR4 targeting guide RNA
augcauaaacagcuggggau

SEQ ID NO: 4812 - RNA, 20 nt, Artificial Sequence
  CXCR4 targeting guide RNA
augcauagauaaucucucca

SEQ ID NO: 4813 - RNA, 20 nt, Artificial Sequence
  CXCR4 targeting guide RNA
augcugguuuuucaguuuuc

SEQ ID NO: 4814 - RNA, 20 nt, Artificial Sequence
  CXCR4 targeting guide RNA
auggagagauuaucuaugca

SEQ ID NO: 4815 - RNA, 20 nt, Artificial Sequence
  CXCR4 targeting guide RNA
auggcacuuauaaccaaagc

SEQ ID NO: 4816 - RNA, 20 nt, Artificial Sequence
  CXCR4 targeting guide RNA
augucucgugguaggacugu

SEQ ID NO: 4817 - RNA, 20 nt, Artificial Sequence
  CXCR4 targeting guide RNA
augugugucuaggcaggacc

SEQ ID NO: 4818 - RNA, 20 nt, Artificial Sequence
  CXCR4 targeting guide RNA
auguucaguucccuuuucua

SEQ ID NO: 4819 - RNA, 20 nt, Artificial Sequence
  CXCR4 targeting guide RNA
auuaucuaugcauaaacagc

SEQ ID NO: 4820 - RNA, 20 nt, Artificial Sequence
  CXCR4 targeting guide RNA
auucacuacacgcucuggaa

SEQ ID NO: 4821 - RNA, 20 nt, Artificial Sequence
  CXCR4 targeting guide RNA
auuccagagcguguagugaa

SEQ ID NO: 4822 - RNA, 20 nt, Artificial Sequence
  CXCR4 targeting guide RNA
auucccguggaacguuuuuc

SEQ ID NO: 4823 - RNA, 20 nt, Artificial Sequence
  CXCR4 targeting guide RNA
auugaugugugucuaggcag

SEQ ID NO: 4824 - RNA, 20 nt, Artificial Sequence
  CXCR4 targeting guide RNA
auugcuuguuggauuuuugu

SEQ ID NO: 4825 - RNA, 20 nt, Artificial Sequence
  CXCR4 targeting guide RNA
auuggucagucuuuuauauc

SEQ ID NO: 4826 - RNA, 20 nt, Artificial Sequence
  CXCR4 targeting guide RNA
auuucagcaccuacagugua

SEQ ID NO: 4827 - RNA, 20 nt, Artificial Sequence
  CXCR4 targeting guide RNA
auuucuagcuuuacgugauu

SEQ ID NO: 4828 - RNA, 20 nt, Artificial Sequence
  CXCR4 targeting guide RNA
auuucuauaccacuuugggc

SEQ ID NO: 4829 - RNA, 20 nt, Artificial Sequence
  CXCR4 targeting guide RNA
auuuugcuguagaagauggc

SEQ ID NO: 4830 - RNA, 20 nt, Artificial Sequence
  CXCR4 targeting guide RNA
caaaaauccaacaagcaaua

SEQ ID NO: 4831 - RNA, 20 nt, Artificial Sequence
  CXCR4 targeting guide RNA
caaaaucacgucuuaagaac

SEQ ID NO: 4832 - RNA, 20 nt, Artificial Sequence
  CXCR4 targeting guide RNA
caaagcccaaagugguauag

SEQ ID NO: 4833 - RNA, 20 nt, Artificial Sequence
  CXCR4 targeting guide RNA
caaagugguauagaaaugcu

SEQ ID NO: 4834 - RNA, 20 nt, Artificial Sequence
  CXCR4 targeting guide RNA
caacaagcaauaaaaacugu

SEQ ID NO: 4835 - RNA, 20 nt, Artificial Sequence
  CXCR4 targeting guide RNA
caacccacuccugaaaacug

SEQ ID NO: 4836 - RNA, 20 nt, Artificial Sequence
  CXCR4 targeting guide RNA
caacuaagaacuuggccaca

SEQ ID NO: 4837 - RNA, 20 nt, Artificial Sequence
  CXCR4 targeting guide RNA
caacuuaauacaagacugua

SEQ ID NO: 4838 - RNA, 20 nt, Artificial Sequence
  CXCR4 targeting guide RNA
caagacaaaaauccaacaag

SEQ ID NO: 4839 - RNA, 20 nt, Artificial Sequence
  CXCR4 targeting guide RNA
caagacuguacacuguaggu

SEQ ID NO: 4840 - RNA, 20 nt, Artificial Sequence
  CXCR4 targeting guide RNA
caagcaauaaaaacuguaca

SEQ ID NO: 4841 - RNA, 20 nt, Artificial Sequence
  CXCR4 targeting guide RNA
caaguucuuaguugcuguau

SEQ ID NO: 4842 - RNA, 20 nt, Artificial Sequence
  CXCR4 targeting guide RNA
caauauuggucagucuuuua

SEQ ID NO: 4843 - RNA, 20 nt, Artificial Sequence
  CXCR4 targeting guide RNA
cacaaaaacuaaagaaacac

SEQ ID NO: 4844 - RNA, 20 nt, Artificial Sequence
  CXCR4 targeting guide RNA
cacaagacaaaaauccaaca

SEQ ID NO: 4845 - RNA, 20 nt, Artificial Sequence
  CXCR4 targeting guide RNA
cacacaucaauaugaaacaa

SEQ ID NO: 4846 - RNA, 20 nt, Artificial Sequence
  CXCR4 targeting guide RNA
cacagauguaaaagacuuuu

SEQ ID NO: 4847 - RNA, 20 nt, Artificial Sequence
  CXCR4 targeting guide RNA
cacagguccugccuagacac

SEQ ID NO: 4848 - RNA, 20 nt, Artificial Sequence
  CXCR4 targeting guide RNA
caccuacaguguacagucuu

SEQ ID NO: 4849 - RNA, 20 nt, Artificial Sequence
  CXCR4 targeting guide RNA
cacgagacauacagcaacua

SEQ ID NO: 4850 - RNA, 20 nt, Artificial Sequence
  CXCR4 targeting guide RNA
cacgcucuggaauguucagu

SEQ ID NO: 4851 - RNA, 20 nt, Artificial Sequence
  CXCR4 targeting guide RNA
cacgggaauggagagauuau

SEQ ID NO: 4852 - RNA, 20 nt, Artificial Sequence
  CXCR4 targeting guide RNA
cacguaaagcuagaaaugau

SEQ ID NO: 4853 - RNA, 20 nt, Artificial Sequence
  CXCR4 targeting guide RNA
cacgucuuaagaacaggaaa

SEQ ID NO: 4854 - RNA, 20 nt, Artificial Sequence
  CXCR4 targeting guide RNA
cacuacacgcucuggaaugu

SEQ ID NO: 4855 - RNA, 20 nt, Artificial Sequence
  CXCR4 targeting guide RNA
cacuccugaaaacugaaaaa

SEQ ID NO: 4856 - RNA, 20 nt, Artificial Sequence
  CXCR4 targeting guide RNA
cacuguaggugcugaaauca

SEQ ID NO: 4857 - RNA, 20 nt, Artificial Sequence
  CXCR4 targeting guide RNA
cacuuauaaccaaagcccaa

SEQ ID NO: 4858 - RNA, 20 nt, Artificial Sequence
  CXCR4 targeting guide RNA
cacuuugggcuuugguuaua

SEQ ID NO: 4859 - RNA, 20 nt, Artificial Sequence
  CXCR4 targeting guide RNA
cagagcguguagugaaucac

SEQ ID NO: 4860 - RNA, 20 nt, Artificial Sequence
  CXCR4 targeting guide RNA
cagauauaaaagacugacca

SEQ ID NO: 4861 - RNA, 20 nt, Artificial Sequence
  CXCR4 targeting guide RNA
cagcaaaaucacgucuuaag

SEQ ID NO: 4862 - RNA, 20 nt, Artificial Sequence
  CXCR4 targeting guide RNA
cagcaacuaagaacuuggcc

SEQ ID NO: 4863 - RNA, 20 nt, Artificial Sequence
  CXCR4 targeting guide RNA
cagcaccuacaguguacagu

SEQ ID NO: 4864 - RNA, 20 nt, Artificial Sequence
  CXCR4 targeting guide RNA
cagcauuucuauaccacuuu

SEQ ID NO: 4865 - RNA, 20 nt, Artificial Sequence
  CXCR4 targeting guide RNA
cagcuggggaucauuucuag

SEQ ID NO: 4866 - RNA, 20 nt, Artificial Sequence
  CXCR4 targeting guide RNA
cagcuguuuaugcauagaua

SEQ ID NO: 4867 - RNA, 20 nt, Artificial Sequence
  CXCR4 targeting guide RNA
caggaaaaacguuccacggg

SEQ ID NO: 4868 - RNA, 20 nt, Artificial Sequence
  CXCR4 targeting guide RNA
caggaccuguggccaaguuc

SEQ ID NO: 4869 - RNA, 20 nt, Artificial Sequence
  CXCR4 targeting guide RNA
caggaguggguugauuucag

SEQ ID NO: 4870 - RNA, 20 nt, Artificial Sequence
  CXCR4 targeting guide RNA
cagguccugccuagacacac

SEQ ID NO: 4871 - RNA, 20 nt, Artificial Sequence
  CXCR4 targeting guide RNA
caguccuaccacgagacaua

SEQ ID NO: 4872 - RNA, 20 nt, Artificial Sequence
  CXCR4 targeting guide RNA
cagucuuguauuaaguuguu

SEQ ID NO: 4873 - RNA, 20 nt, Artificial Sequence
  CXCR4 targeting guide RNA
caguguacagucuuguauua

SEQ ID NO: 4874 - RNA, 20 nt, Artificial Sequence
  CXCR4 targeting guide RNA
caguucccuuuucuacaguc

SEQ ID NO: 4875 - RNA, 20 nt, Artificial Sequence
  CXCR4 targeting guide RNA
caguuuucaggaguggguug

SEQ ID NO: 4876 - RNA, 20 nt, Artificial Sequence
  CXCR4 targeting guide RNA
caguuuuuauugcuuguugg

SEQ ID NO: 4877 - RNA, 20 nt, Artificial Sequence
  CXCR4 targeting guide RNA
cauaaacagcuggggaucau

SEQ ID NO: 4878 - RNA, 20 nt, Artificial Sequence
  CXCR4 targeting guide RNA
cauacagcaacuaagaacuu

SEQ ID NO: 4879 - RNA, 20 nt, Artificial Sequence
  CXCR4 targeting guide RNA
cauagauaaucucuccauuc

SEQ ID NO: 4880 - RNA, 20 nt, Artificial Sequence
  CXCR4 targeting guide RNA
cauauugaugugugucuagg

SEQ ID NO: 4881 - RNA, 20 nt, Artificial Sequence
  CXCR4 targeting guide RNA
caucuucuacagcaaaauca

SEQ ID NO: 4882 - RNA, 20 nt, Artificial Sequence
  CXCR4 targeting guide RNA
cauuccagagcguguaguga

SEQ ID NO: 4883 - RNA, 20 nt, Artificial Sequence
  CXCR4 targeting guide RNA
cauucccguggaacguuuuu

SEQ ID NO: 4884 - RNA, 20 nt, Artificial Sequence
  CXCR4 targeting guide RNA
cauuucuagcuuuacgugau

SEQ ID NO: 4885 - RNA, 20 nt, Artificial Sequence
  CXCR4 targeting guide RNA
cauuucuauaccacuuuggg

SEQ ID NO: 4886 - RNA, 20 nt, Artificial Sequence
  CXCR4 targeting guide RNA
ccaaagcccaaagugguaua

SEQ ID NO: 4887 - RNA, 20 nt, Artificial Sequence
  CXCR4 targeting guide RNA
ccaaagugguauagaaaugc

SEQ ID NO: 4888 - RNA, 20 nt, Artificial Sequence
  CXCR4 targeting guide RNA
ccaacaagcaauaaaaacug

SEQ ID NO: 4889 - RNA, 20 nt, Artificial Sequence
  CXCR4 targeting guide RNA
ccaaguucuuaguugcugua

SEQ ID NO: 4890 - RNA, 20 nt, Artificial Sequence
  CXCR4 targeting guide RNA
ccacagguccugccuagaca

SEQ ID NO: 4891 - RNA, 20 nt, Artificial Sequence
  CXCR4 targeting guide RNA
ccacgagacauacagcaacu

SEQ ID NO: 4892 - RNA, 20 nt, Artificial Sequence
  CXCR4 targeting guide RNA
ccacgggaauggagagauua

SEQ ID NO: 4893 - RNA, 20 nt, Artificial Sequence
  CXCR4 targeting guide RNA
ccacuccugaaaacugaaaa

SEQ ID NO: 4894 - RNA, 20 nt, Artificial Sequence
  CXCR4 targeting guide RNA
ccacuuugggcuuugguuau

SEQ ID NO: 4895 - RNA, 20 nt, Artificial Sequence
  CXCR4 targeting guide RNA
ccagagcguguagugaauca

SEQ ID NO: 4896 - RNA, 20 nt, Artificial Sequence
  CXCR4 targeting guide RNA
ccagcauuucuauaccacuu

SEQ ID NO: 4897 - RNA, 20 nt, Artificial Sequence
  CXCR4 targeting guide RNA
ccagcuguuuaugcauagau

SEQ ID NO: 4898 - RNA, 20 nt, Artificial Sequence
  CXCR4 targeting guide RNA
ccaucuucuacagcaaaauc

SEQ ID NO: 4899 - RNA, 20 nt, Artificial Sequence
  CXCR4 targeting guide RNA
ccauucccguggaacguuuu

SEQ ID NO: 4900 - RNA, 20 nt, Artificial Sequence
  CXCR4 targeting guide RNA
cccaaagugguauagaaaug

SEQ ID NO: 4901 - RNA, 20 nt, Artificial Sequence
  CXCR4 targeting guide RNA
cccacuccugaaaacugaaa

SEQ ID NO: 4902 - RNA, 20 nt, Artificial Sequence
  CXCR4 targeting guide RNA
cccagcuguuuaugcauaga

SEQ ID NO: 4903 - RNA, 20 nt, Artificial Sequence
  CXCR4 targeting guide RNA
ccccagcuguuuaugcauag

SEQ ID NO: 4904 - RNA, 20 nt, Artificial Sequence
  CXCR4 targeting guide RNA
cccguggaacguuuuuccug

SEQ ID NO: 4905 - RNA, 20 nt, Artificial Sequence
  CXCR4 targeting guide RNA
cccuuuucuacaguccuacc

SEQ ID NO: 4906 - RNA, 20 nt, Artificial Sequence
  CXCR4 targeting guide RNA
ccguggaacguuuuuccugu

SEQ ID NO: 4907 - RNA, 20 nt, Artificial Sequence
  CXCR4 targeting guide RNA
ccuacaguguacagucuugu

SEQ ID NO: 4908 - RNA, 20 nt, Artificial Sequence
  CXCR4 targeting guide RNA
ccuaccacgagacauacagc

SEQ ID NO: 4909 - RNA, 20 nt, Artificial Sequence
  CXCR4 targeting guide RNA
ccuagacacacaucaauaug

SEQ ID NO: 4910 - RNA, 20 nt, Artificial Sequence
  CXCR4 targeting guide RNA
ccugaaaacugaaaaaccag

SEQ ID NO: 4911 - RNA, 20 nt, Artificial Sequence
  CXCR4 targeting guide RNA
ccugccuagacacacaucaa

SEQ ID NO: 4912 - RNA, 20 nt, Artificial Sequence
  CXCR4 targeting guide RNA
ccuguggccaaguucuuagu

SEQ ID NO: 4913 - RNA, 20 nt, Artificial Sequence
  CXCR4 targeting guide RNA
ccuguucuuaagacgugauu

SEQ ID NO: 4914 - RNA, 20 nt, Artificial Sequence
  CXCR4 targeting guide RNA
ccuuuucuacaguccuacca

SEQ ID NO: 4915 - RNA, 20 nt, Artificial Sequence
  CXCR4 targeting guide RNA
cgagacauacagcaacuaag

SEQ ID NO: 4916 - RNA, 20 nt, Artificial Sequence
  CXCR4 targeting guide RNA
cgcucuggaauguucaguuc

SEQ ID NO: 4917 - RNA, 20 nt, Artificial Sequence
  CXCR4 targeting guide RNA
cgggaauggagagauuaucu

SEQ ID NO: 4918 - RNA, 20 nt, Artificial Sequence
  CXCR4 targeting guide RNA
cguaaagcuagaaaugaucc

SEQ ID NO: 4919 - RNA, 20 nt, Artificial Sequence
  CXCR4 targeting guide RNA
cgucuuaagaacaggaaaaa

SEQ ID NO: 4920 - RNA, 20 nt, Artificial Sequence
  CXCR4 targeting guide RNA
cgugauucacuacacgcucu

SEQ ID NO: 4921 - RNA, 20 nt, Artificial Sequence
  CXCR4 targeting guide RNA
cgugauuuugcuguagaaga

SEQ ID NO: 4922 - RNA, 20 nt, Artificial Sequence
  CXCR4 targeting guide RNA
cguggaacguuuuuccuguu

SEQ ID NO: 4923 - RNA, 20 nt, Artificial Sequence
  CXCR4 targeting guide RNA
cgugguaggacuguagaaaa

SEQ ID NO: 4924 - RNA, 20 nt, Artificial Sequence
  CXCR4 targeting guide RNA
cguguagugaaucacguaaa

SEQ ID NO: 4925 - RNA, 20 nt, Artificial Sequence
  CXCR4 targeting guide RNA
cguuccacgggaauggagag

SEQ ID NO: 4926 - RNA, 20 nt, Artificial Sequence
  CXCR4 targeting guide RNA
cguuuuuccuguucuuaaga

SEQ ID NO: 4927 - RNA, 20 nt, Artificial Sequence
  CXCR4 targeting guide RNA
cuaaagaaacacaagacaaa

SEQ ID NO: 4928 - RNA, 20 nt, Artificial Sequence
  CXCR4 targeting guide RNA
cuaagaacuuggccacaggu

SEQ ID NO: 4929 - RNA, 20 nt, Artificial Sequence
  CXCR4 targeting guide RNA
cuacacgcucuggaauguuc

SEQ ID NO: 4930 - RNA, 20 nt, Artificial Sequence
  CXCR4 targeting guide RNA
cuacagcaaaaucacgucuu

SEQ ID NO: 4931 - RNA, 20 nt, Artificial Sequence
  CXCR4 targeting guide RNA
cuacaguccuaccacgagac

SEQ ID NO: 4932 - RNA, 20 nt, Artificial Sequence
  CXCR4 targeting guide RNA
cuacaguguacagucuugua

SEQ ID NO: 4933 - RNA, 20 nt, Artificial Sequence
  CXCR4 targeting guide RNA
cuaccacgagacauacagca

SEQ ID NO: 4934 - RNA, 20 nt, Artificial Sequence
  CXCR4 targeting guide RNA
cuagaaaugauccccagcug

SEQ ID NO: 4935 - RNA, 20 nt, Artificial Sequence
  CXCR4 targeting guide RNA
cuagacacacaucaauauga

SEQ ID NO: 4936 - RNA, 20 nt, Artificial Sequence
  CXCR4 targeting guide RNA
cuagcuuuacgugauucacu

SEQ ID NO: 4937 - RNA, 20 nt, Artificial Sequence
  CXCR4 targeting guide RNA
cuaggcaggaccuguggcca

SEQ ID NO: 4938 - RNA, 20 nt, Artificial Sequence
  CXCR4 targeting guide RNA
cuauaccacuuugggcuuug

SEQ ID NO: 4939 - RNA, 20 nt, Artificial Sequence
  CXCR4 targeting guide RNA
cuaugcauaaacagcugggg

SEQ ID NO: 4940 - RNA, 20 nt, Artificial Sequence
  CXCR4 targeting guide RNA
cuccauucccguggaacguu

SEQ ID NO: 4941 - RNA, 20 nt, Artificial Sequence
  CXCR4 targeting guide RNA
cuccugaaaacugaaaaacc

SEQ ID NO: 4942 - RNA, 20 nt, Artificial Sequence
  CXCR4 targeting guide RNA
cucgugguaggacuguagaa

SEQ ID NO: 4943 - RNA, 20 nt, Artificial Sequence
  CXCR4 targeting guide RNA
cucuccauucccguggaacg

SEQ ID NO: 4944 - RNA, 20 nt, Artificial Sequence
  CXCR4 targeting guide RNA
cucuggaauguucaguuccc

SEQ ID NO: 4945 - RNA, 20 nt, Artificial Sequence
  CXCR4 targeting guide RNA
cugaaaaaccagcauuucua

SEQ ID NO: 4946 - RNA, 20 nt, Artificial Sequence
  CXCR4 targeting guide RNA
cugaaaacugaaaaaccagc

SEQ ID NO: 4947 - RNA, 20 nt, Artificial Sequence
  CXCR4 targeting guide RNA
cugaaaucaacccacuccug

SEQ ID NO: 4948 - RNA, 20 nt, Artificial Sequence
  CXCR4 targeting guide RNA
cugaacauuccagagcgugu

SEQ ID NO: 4949 - RNA, 20 nt, Artificial Sequence
  CXCR4 targeting guide RNA
cugaccaauauuguacaguu

SEQ ID NO: 4950 - RNA, 20 nt, Artificial Sequence
  CXCR4 targeting guide RNA
cugccuagacacacaucaau

SEQ ID NO: 4951 - RNA, 20 nt, Artificial Sequence
  CXCR4 targeting guide RNA
cuggaauguucaguucccuu

SEQ ID NO: 4952 - RNA, 20 nt, Artificial Sequence
  CXCR4 targeting guide RNA
cuggggaucauuucuagcuu

SEQ ID NO: 4953 - RNA, 20 nt, Artificial Sequence
  CXCR4 targeting guide RNA
cugguuuuucaguuuucagg

SEQ ID NO: 4954 - RNA, 20 nt, Artificial Sequence
  CXCR4 targeting guide RNA
cuguacaauauuggucaguc

SEQ ID NO: 4955 - RNA, 20 nt, Artificial Sequence
  CXCR4 targeting guide RNA
cuguacacuguaggugcuga

SEQ ID NO: 4956 - RNA, 20 nt, Artificial Sequence
  CXCR4 targeting guide RNA
cuguagaaaagggaacugaa

SEQ ID NO: 4957 - RNA, 20 nt, Artificial Sequence
  CXCR4 targeting guide RNA
cuguagaagauggcacuuau

SEQ ID NO: 4958 - RNA, 20 nt, Artificial Sequence
  CXCR4 targeting guide RNA
cuguaggugcugaaaucaac

SEQ ID NO: 4959 - RNA, 20 nt, Artificial Sequence
  CXCR4 targeting guide RNA
cuguaugucucgugguagga

SEQ ID NO: 4960 - RNA, 20 nt, Artificial Sequence
  CXCR4 targeting guide RNA
cuguggccaaguucuuaguu

SEQ ID NO: 4961 - RNA, 20 nt, Artificial Sequence
  CXCR4 targeting guide RNA
cuguucuuaagacgugauuu

SEQ ID NO: 4962 - RNA, 20 nt, Artificial Sequence
  CXCR4 targeting guide RNA
cuguuuaugcauagauaauc

SEQ ID NO: 4963 - RNA, 20 nt, Artificial Sequence
  CXCR4 targeting guide RNA
cuuaagaacaggaaaaacgu

SEQ ID NO: 4964 - RNA, 20 nt, Artificial Sequence
  CXCR4 targeting guide RNA
cuuaagacgugauuuugcug

SEQ ID NO: 4965 - RNA, 20 nt, Artificial Sequence
  CXCR4 targeting guide RNA
cuuaauacaagacuguacac

SEQ ID NO: 4966 - RNA, 20 nt, Artificial Sequence
  CXCR4 targeting guide RNA
cuuaguugcuguaugucucg

SEQ ID NO: 4967 - RNA, 20 nt, Artificial Sequence
  CXCR4 targeting guide RNA
cuuauaaccaaagcccaaag

SEQ ID NO: 4968 - RNA, 20 nt, Artificial Sequence
  CXCR4 targeting guide RNA
cuucuacagcaaaaucacgu

SEQ ID NO: 4969 - RNA, 20 nt, Artificial Sequence
  CXCR4 targeting guide RNA
cuuggccacagguccugccu

SEQ ID NO: 4970 - RNA, 20 nt, Artificial Sequence
  CXCR4 targeting guide RNA
cuuguuggauuuuugucuug

SEQ ID NO: 4971 - RNA, 20 nt, Artificial Sequence
  CXCR4 targeting guide RNA
cuuuacgugauucacuacac

SEQ ID NO: 4972 - RNA, 20 nt, Artificial Sequence
  CXCR4 targeting guide RNA
cuuugggcuuugguuauaag

SEQ ID NO: 4973 - RNA, 20 nt, Artificial Sequence
  CXCR4 targeting guide RNA
cuuugguuauaagugccauc

SEQ ID NO: 4974 - RNA, 20 nt, Artificial Sequence
  CXCR4 targeting guide RNA
cuuuucuacaguccuaccac

SEQ ID NO: 4975 - RNA, 20 nt, Artificial Sequence
  CXCR4 targeting guide RNA
gaaaaaccagcauuucuaua

SEQ ID NO: 4976 - RNA, 20 nt, Artificial Sequence
  CXCR4 targeting guide RNA
gaaaaacguuccacgggaau

SEQ ID NO: 4977 - RNA, 20 nt, Artificial Sequence
  CXCR4 targeting guide RNA
gaaaacugaaaaaccagcau

SEQ ID NO: 4978 - RNA, 20 nt, Artificial Sequence
  CXCR4 targeting guide RNA
gaaaagggaacugaacauuc

SEQ ID NO: 4979 - RNA, 20 nt, Artificial Sequence
  CXCR4 targeting guide RNA
gaaacacaagacaaaaaucc

SEQ ID NO: 4980 - RNA, 20 nt, Artificial Sequence
  CXCR4 targeting guide RNA
gaaaucaacccacuccugaa

SEQ ID NO: 4981 - RNA, 20 nt, Artificial Sequence
  CXCR4 targeting guide RNA
gaaaugauccccagcuguuu

SEQ ID NO: 4982 - RNA, 20 nt, Artificial Sequence
  CXCR4 targeting guide RNA
gaaaugcugguuuuucaguu

SEQ ID NO: 4983 - RNA, 20 nt, Artificial Sequence
  CXCR4 targeting guide RNA
gaacaggaaaaacguuccac

SEQ ID NO: 4984 - RNA, 20 nt, Artificial Sequence
  CXCR4 targeting guide RNA
gaacauuccagagcguguag

SEQ ID NO: 4985 - RNA, 20 nt, Artificial Sequence
  CXCR4 targeting guide RNA
gaacguuuuuccuguucuua

SEQ ID NO: 4986 - RNA, 20 nt, Artificial Sequence
  CXCR4 targeting guide RNA
gaacugaacauuccagagcg

SEQ ID NO: 4987 - RNA, 20 nt, Artificial Sequence
  CXCR4 targeting guide RNA
gaacuuggccacagguccug

SEQ ID NO: 4988 - RNA, 20 nt, Artificial Sequence
  CXCR4 targeting guide RNA
gaagauggcacuuauaacca

SEQ ID NO: 4989 - RNA, 20 nt, Artificial Sequence
  CXCR4 targeting guide RNA
gaaucacguaaagcuagaaa

SEQ ID NO: 4990 - RNA, 20 nt, Artificial Sequence
  CXCR4 targeting guide RNA
gaauggagagauuaucuaug

SEQ ID NO: 4991 - RNA, 20 nt, Artificial Sequence
  CXCR4 targeting guide RNA
gaauguucaguucccuuuuc

SEQ ID NO: 4992 - RNA, 20 nt, Artificial Sequence
  CXCR4 targeting guide RNA
gacaaaaauccaacaagcaa

SEQ ID NO: 4993 - RNA, 20 nt, Artificial Sequence
  CXCR4 targeting guide RNA
gacacacaucaauaugaaac

SEQ ID NO: 4994 - RNA, 20 nt, Artificial Sequence
  CXCR4 targeting guide RNA
gacauacagcaacuaagaac

SEQ ID NO: 4995 - RNA, 20 nt, Artificial Sequence
  CXCR4 targeting guide RNA
gaccaauauuguacaguuuu

SEQ ID NO: 4996 - RNA, 20 nt, Artificial Sequence
  CXCR4 targeting guide RNA
gaccuguggccaaguucuua

SEQ ID NO: 4997 - RNA, 20 nt, Artificial Sequence
  CXCR4 targeting guide RNA
gacgugauuuugcuguagaa

SEQ ID NO: 4998 - RNA, 20 nt, Artificial Sequence
  CXCR4 targeting guide RNA
gacugaccaauauuguacag

SEQ ID NO: 4999 - RNA, 20 nt, Artificial Sequence
  CXCR4 targeting guide RNA
gacuguacacuguaggugcu

SEQ ID NO: 5000 - RNA, 20 nt, Artificial Sequence
  CXCR4 targeting guide RNA
gacuguagaaaagggaacug

SEQ ID NO: 5001 - RNA, 20 nt, Artificial Sequence
  CXCR4 targeting guide RNA
gagacauacagcaacuaaga

SEQ ID NO: 5002 - RNA, 20 nt, Artificial Sequence
  CXCR4 targeting guide RNA
gagagauuaucuaugcauaa

SEQ ID NO: 5003 - RNA, 20 nt, Artificial Sequence
  CXCR4 targeting guide RNA
gagauuaucuaugcauaaac

SEQ ID NO: 5004 - RNA, 20 nt, Artificial Sequence
  CXCR4 targeting guide RNA
gagcguguagugaaucacgu

SEQ ID NO: 5005 - RNA, 20 nt, Artificial Sequence
  CXCR4 targeting guide RNA
gaguggguugauuucagcac

SEQ ID NO: 5006 - RNA, 20 nt, Artificial Sequence
  CXCR4 targeting guide RNA
gauaaucucuccauucccgu

SEQ ID NO: 5007 - RNA, 20 nt, Artificial Sequence
  CXCR4 targeting guide RNA
gauauaaaagacugaccaau

SEQ ID NO: 5008 - RNA, 20 nt, Artificial Sequence
  CXCR4 targeting guide RNA
gaucauuucuagcuuuacgu

SEQ ID NO: 5009 - RNA, 20 nt, Artificial Sequence
  CXCR4 targeting guide RNA
gauccccagcuguuuaugca

SEQ ID NO: 5010 - RNA, 20 nt, Artificial Sequence
  CXCR4 targeting guide RNA
gauggcacuuauaaccaaag

SEQ ID NO: 5011 - RNA, 20 nt, Artificial Sequence
  CXCR4 targeting guide RNA
gaugugugucuaggcaggac

SEQ ID NO: 5012 - RNA, 20 nt, Artificial Sequence
  CXCR4 targeting guide RNA
gauuaucuaugcauaaacag

SEQ ID NO: 5013 - RNA, 20 nt, Artificial Sequence
  CXCR4 targeting guide RNA
gauucacuacacgcucugga

SEQ ID NO: 5014 - RNA, 20 nt, Artificial Sequence
  CXCR4 targeting guide RNA
gauuucagcaccuacagugu

SEQ ID NO: 5015 - RNA, 20 nt, Artificial Sequence
  CXCR4 targeting guide RNA
gauuuugcuguagaagaugg

SEQ ID NO: 5016 - RNA, 20 nt, Artificial Sequence
  CXCR4 targeting guide RNA
gauuuuugucuuguguuucu

SEQ ID NO: 5017 - RNA, 20 nt, Artificial Sequence
  CXCR4 targeting guide RNA
gcaaaaucacgucuuaagaa

SEQ ID NO: 5018 - RNA, 20 nt, Artificial Sequence
  CXCR4 targeting guide RNA
gcaacuaagaacuuggccac

SEQ ID NO: 5019 - RNA, 20 nt, Artificial Sequence
  CXCR4 targeting guide RNA
gcaccuacaguguacagucu

SEQ ID NO: 5020 - RNA, 20 nt, Artificial Sequence
  CXCR4 targeting guide RNA
gcacuuauaaccaaagccca

SEQ ID NO: 5021 - RNA, 20 nt, Artificial Sequence
  CXCR4 targeting guide RNA
gcaggaccuguggccaaguu

SEQ ID NO: 5022 - RNA, 20 nt, Artificial Sequence
  CXCR4 targeting guide RNA
gcauaaacagcuggggauca

SEQ ID NO: 5023 - RNA, 20 nt, Artificial Sequence
  CXCR4 targeting guide RNA
gcauagauaaucucuccauu

SEQ ID NO: 5024 - RNA, 20 nt, Artificial Sequence
  CXCR4 targeting guide RNA
gcauuucuauaccacuuugg

SEQ ID NO: 5025 - RNA, 20 nt, Artificial Sequence
  CXCR4 targeting guide RNA
gccaaguucuuaguugcugu

SEQ ID NO: 5026 - RNA, 20 nt, Artificial Sequence
  CXCR4 targeting guide RNA
gccacagguccugccuagac

SEQ ID NO: 5027 - RNA, 20 nt, Artificial Sequence
  CXCR4 targeting guide RNA
gccaucuucuacagcaaaau

SEQ ID NO: 5028 - RNA, 20 nt, Artificial Sequence
  CXCR4 targeting guide RNA
gcccaaagugguauagaaau

SEQ ID NO: 5029 - RNA, 20 nt, Artificial Sequence
  CXCR4 targeting guide RNA
gccuagacacacaucaauau

SEQ ID NO: 5030 - RNA, 20 nt, Artificial Sequence
  CXCR4 targeting guide RNA
gcguguagugaaucacguaa

SEQ ID NO: 5031 - RNA, 20 nt, Artificial Sequence
  CXCR4 targeting guide RNA
gcuagaaaugauccccagcu

SEQ ID NO: 5032 - RNA, 20 nt, Artificial Sequence
  CXCR4 targeting guide RNA
gcucuggaauguucaguucc

SEQ ID NO: 5033 - RNA, 20 nt, Artificial Sequence
  CXCR4 targeting guide RNA
gcugaaaucaacccacuccu

SEQ ID NO: 5034 - RNA, 20 nt, Artificial Sequence
  CXCR4 targeting guide RNA
gcuggggaucauuucuagcu

SEQ ID NO: 5035 - RNA, 20 nt, Artificial Sequence
  CXCR4 targeting guide RNA
gcugguuuuucaguuuucag

SEQ ID NO: 5036 - RNA, 20 nt, Artificial Sequence
  CXCR4 targeting guide RNA
gcuguagaagauggcacuua

SEQ ID NO: 5037 - RNA, 20 nt, Artificial Sequence
  CXCR4 targeting guide RNA
gcuguaugucucgugguagg

SEQ ID NO: 5038 - RNA, 20 nt, Artificial Sequence
  CXCR4 targeting guide RNA
gcuguuuaugcauagauaau

SEQ ID NO: 5039 - RNA, 20 nt, Artificial Sequence
  CXCR4 targeting guide RNA
gcuuguuggauuuuugucuu

SEQ ID NO: 5040 - RNA, 20 nt, Artificial Sequence
  CXCR4 targeting guide RNA
gcuuuacgugauucacuaca

SEQ ID NO: 5041 - RNA, 20 nt, Artificial Sequence
  CXCR4 targeting guide RNA
gcuuugguuauaagugccau

SEQ ID NO: 5042 - RNA, 20 nt, Artificial Sequence
  CXCR4 targeting guide RNA
ggaaaaacguuccacgggaa

SEQ ID NO: 5043 - RNA, 20 nt, Artificial Sequence
  CXCR4 targeting guide RNA
ggaacguuuuuccuguucuu

SEQ ID NO: 5044 - RNA, 20 nt, Artificial Sequence
  CXCR4 targeting guide RNA
ggaacugaacauuccagagc

SEQ ID NO: 5045 - RNA, 20 nt, Artificial Sequence
  CXCR4 targeting guide RNA
ggaauggagagauuaucuau

SEQ ID NO: 5046 - RNA, 20 nt, Artificial Sequence
  CXCR4 targeting guide RNA
ggaauguucaguucccuuuu

SEQ ID NO: 5047 - RNA, 20 nt, Artificial Sequence
  CXCR4 targeting guide RNA
ggaccuguggccaaguucuu

SEQ ID NO: 5048 - RNA, 20 nt, Artificial Sequence
  CXCR4 targeting guide RNA
ggacuguagaaaagggaacu

SEQ ID NO: 5049 - RNA, 20 nt, Artificial Sequence
  CXCR4 targeting guide RNA
ggagagauuaucuaugcaua

SEQ ID NO: 5050 - RNA, 20 nt, Artificial Sequence
  CXCR4 targeting guide RNA
ggaguggguugauuucagca

SEQ ID NO: 5051 - RNA, 20 nt, Artificial Sequence
  CXCR4 targeting guide RNA
ggaucauuucuagcuuuacg

SEQ ID NO: 5052 - RNA, 20 nt, Artificial Sequence
  CXCR4 targeting guide RNA
ggauuuuugucuuguguuuc

SEQ ID NO: 5053 - RNA, 20 nt, Artificial Sequence
  CXCR4 targeting guide RNA
ggcacuuauaaccaaagccc

SEQ ID NO: 5054 - RNA, 20 nt, Artificial Sequence
  CXCR4 targeting guide RNA
ggcaggaccuguggccaagu

SEQ ID NO: 5055 - RNA, 20 nt, Artificial Sequence
  CXCR4 targeting guide RNA
ggccaaguucuuaguugcug

SEQ ID NO: 5056 - RNA, 20 nt, Artificial Sequence
  CXCR4 targeting guide RNA
ggccacagguccugccuaga

SEQ ID NO: 5057 - RNA, 20 nt, Artificial Sequence
  CXCR4 targeting guide RNA
ggcuuugguuauaagugcca

SEQ ID NO: 5058 - RNA, 20 nt, Artificial Sequence
  CXCR4 targeting guide RNA
gggaacugaacauuccagag

SEQ ID NO: 5059 - RNA, 20 nt, Artificial Sequence
  CXCR4 targeting guide RNA
gggaauggagagauuaucua

SEQ ID NO: 5060 - RNA, 20 nt, Artificial Sequence
  CXCR4 targeting guide RNA
gggaucauuucuagcuuuac

SEQ ID NO: 5061 - RNA, 20 nt, Artificial Sequence
  CXCR4 targeting guide RNA
gggcuuugguuauaagugcc

SEQ ID NO: 5062 - RNA, 20 nt, Artificial Sequence
  CXCR4 targeting guide RNA
ggggaucauuucuagcuuua

SEQ ID NO: 5063 - RNA, 20 nt, Artificial Sequence
  CXCR4 targeting guide RNA
ggguugauuucagcaccuac

SEQ ID NO: 5064 - RNA, 20 nt, Artificial Sequence
  CXCR4 targeting guide RNA
gguaggacuguagaaaaggg

SEQ ID NO: 5065 - RNA, 20 nt, Artificial Sequence
  CXCR4 targeting guide RNA
gguauagaaaugcugguuuu

SEQ ID NO: 5066 - RNA, 20 nt, Artificial Sequence
  CXCR4 targeting guide RNA
ggucagucuuuuauaucuga

SEQ ID NO: 5067 - RNA, 20 nt, Artificial Sequence
  CXCR4 targeting guide RNA
gguccugccuagacacacau

SEQ ID NO: 5068 - RNA, 20 nt, Artificial Sequence
  CXCR4 targeting guide RNA
ggugcugaaaucaacccacu

SEQ ID NO: 5069 - RNA, 20 nt, Artificial Sequence
  CXCR4 targeting guide RNA
gguuauaagugccaucuucu

SEQ ID NO: 5070 - RNA, 20 nt, Artificial Sequence
  CXCR4 targeting guide RNA
gguugauuucagcaccuaca

SEQ ID NO: 5071 - RNA, 20 nt, Artificial Sequence
  CXCR4 targeting guide RNA
gguuuuucaguuuucaggag

SEQ ID NO: 5072 - RNA, 20 nt, Artificial Sequence
  CXCR4 targeting guide RNA
guaaagcuagaaaugauccc

SEQ ID NO: 5073 - RNA, 20 nt, Artificial Sequence
  CXCR4 targeting guide RNA
guacaauauuggucagucuu

SEQ ID NO: 5074 - RNA, 20 nt, Artificial Sequence
  CXCR4 targeting guide RNA
guacacuguaggugcugaaa

SEQ ID NO: 5075 - RNA, 20 nt, Artificial Sequence
  CXCR4 targeting guide RNA
guacagucuuguauuaaguu

SEQ ID NO: 5076 - RNA, 20 nt, Artificial Sequence
  CXCR4 targeting guide RNA
guacaguuuuuauugcuugu

SEQ ID NO: 5077 - RNA, 20 nt, Artificial Sequence
  CXCR4 targeting guide RNA
guagaaaagggaacugaaca

SEQ ID NO: 5078 - RNA, 20 nt, Artificial Sequence
  CXCR4 targeting guide RNA
guagaagauggcacuuauaa

SEQ ID NO: 5079 - RNA, 20 nt, Artificial Sequence
  CXCR4 targeting guide RNA
guaggacuguagaaaaggga

SEQ ID NO: 5080 - RNA, 20 nt, Artificial Sequence
  CXCR4 targeting guide RNA
guaggugcugaaaucaaccc

SEQ ID NO: 5081 - RNA, 20 nt, Artificial Sequence
  CXCR4 targeting guide RNA
guagugaaucacguaaagcu

SEQ ID NO: 5082 - RNA, 20 nt, Artificial Sequence
  CXCR4 targeting guide RNA
guauagaaaugcugguuuuu

SEQ ID NO: 5083 - RNA, 20 nt, Artificial Sequence
  CXCR4 targeting guide RNA
guaugucucgugguaggacu

SEQ ID NO: 5084 - RNA, 20 nt, Artificial Sequence
  CXCR4 targeting guide RNA
gucagucuuuuauaucugaa

SEQ ID NO: 5085 - RNA, 20 nt, Artificial Sequence
  CXCR4 targeting guide RNA
guccuaccacgagacauaca

SEQ ID NO: 5086 - RNA, 20 nt, Artificial Sequence
  CXCR4 targeting guide RNA
guccugccuagacacacauc

SEQ ID NO: 5087 - RNA, 20 nt, Artificial Sequence
  CXCR4 targeting guide RNA
gucuaggcaggaccuguggc

SEQ ID NO: 5088 - RNA, 20 nt, Artificial Sequence
  CXCR4 targeting guide RNA
gucucgugguaggacuguag

SEQ ID NO: 5089 - RNA, 20 nt, Artificial Sequence
  CXCR4 targeting guide RNA
gucuuaagaacaggaaaaac

SEQ ID NO: 5090 - RNA, 20 nt, Artificial Sequence
  CXCR4 targeting guide RNA
gucuuguguuucuuuaguuu

SEQ ID NO: 5091 - RNA, 20 nt, Artificial Sequence
  CXCR4 targeting guide RNA
gugaaucacguaaagcuaga

SEQ ID NO: 5092 - RNA, 20 nt, Artificial Sequence
  CXCR4 targeting guide RNA
gugauucacuacacgcucug

SEQ ID NO: 5093 - RNA, 20 nt, Artificial Sequence
  CXCR4 targeting guide RNA
gugauuuugcuguagaagau

SEQ ID NO: 5094 - RNA, 20 nt, Artificial Sequence
  CXCR4 targeting guide RNA
gugccaucuucuacagcaaa

SEQ ID NO: 5095 - RNA, 20 nt, Artificial Sequence
  CXCR4 targeting guide RNA
gugcugaaaucaacccacuc

SEQ ID NO: 5096 - RNA, 20 nt, Artificial Sequence
  CXCR4 targeting guide RNA
guggaacguuuuuccuguuc

SEQ ID NO: 5097 - RNA, 20 nt, Artificial Sequence
  CXCR4 targeting guide RNA
guggccaaguucuuaguugc

SEQ ID NO: 5098 - RNA, 20 nt, Artificial Sequence
  CXCR4 targeting guide RNA
guggguugauuucagcaccu

SEQ ID NO: 5099 - RNA, 20 nt, Artificial Sequence
  CXCR4 targeting guide RNA
gugguaggacuguagaaaag

SEQ ID NO: 5100 - RNA, 20 nt, Artificial Sequence
  CXCR4 targeting guide RNA
gugguauagaaaugcugguu

SEQ ID NO: 5101 - RNA, 20 nt, Artificial Sequence
  CXCR4 targeting guide RNA
guguacagucuuguauuaag

SEQ ID NO: 5102 - RNA, 20 nt, Artificial Sequence
  CXCR4 targeting guide RNA
guguagugaaucacguaaag

SEQ ID NO: 5103 - RNA, 20 nt, Artificial Sequence
  CXCR4 targeting guide RNA
gugucuaggcaggaccugug

SEQ ID NO: 5104 - RNA, 20 nt, Artificial Sequence
  CXCR4 targeting guide RNA
gugugucuaggcaggaccug

SEQ ID NO: 5105 - RNA, 20 nt, Artificial Sequence
  CXCR4 targeting guide RNA
guguuucuuuaguuuuugug

SEQ ID NO: 5106 - RNA, 20 nt, Artificial Sequence
  CXCR4 targeting guide RNA
guuauaagugccaucuucua

SEQ ID NO: 5107 - RNA, 20 nt, Artificial Sequence
  CXCR4 targeting guide RNA
guucaguucccuuuucuaca

SEQ ID NO: 5108 - RNA, 20 nt, Artificial Sequence
  CXCR4 targeting guide RNA
guuccacgggaauggagaga

SEQ ID NO: 5109 - RNA, 20 nt, Artificial Sequence
  CXCR4 targeting guide RNA
guucccuuuucuacaguccu

SEQ ID NO: 5110 - RNA, 20 nt, Artificial Sequence
  CXCR4 targeting guide RNA
guucuuaagacgugauuuug

SEQ ID NO: 5111 - RNA, 20 nt, Artificial Sequence
  CXCR4 targeting guide RNA
guucuuaguugcuguauguc

SEQ ID NO: 5112 - RNA, 20 nt, Artificial Sequence
  CXCR4 targeting guide RNA
guugauuucagcaccuacag

SEQ ID NO: 5113 - RNA, 20 nt, Artificial Sequence
  CXCR4 targeting guide RNA
guugcuguaugucucguggu

SEQ ID NO: 5114 - RNA, 20 nt, Artificial Sequence
  CXCR4 targeting guide RNA
guuggauuuuugucuugugu

SEQ ID NO: 5115 - RNA, 20 nt, Artificial Sequence
  CXCR4 targeting guide RNA
guuuaugcauagauaaucuc

SEQ ID NO: 5116 - RNA, 20 nt, Artificial Sequence
  CXCR4 targeting guide RNA
guuucauauugauguguguc

SEQ ID NO: 5117 - RNA, 20 nt, Artificial Sequence
  CXCR4 targeting guide RNA
guuuucaggaguggguugau

SEQ ID NO: 5118 - RNA, 20 nt, Artificial Sequence
  CXCR4 targeting guide RNA
guuuuuauugcuuguuggau

SEQ ID NO: 5119 - RNA, 20 nt, Artificial Sequence
  CXCR4 targeting guide RNA
guuuuucaguuuucaggagu

SEQ ID NO: 5120 - RNA, 20 nt, Artificial Sequence
  CXCR4 targeting guide RNA
guuuuuccuguucuuaagac

SEQ ID NO: 5121 - RNA, 20 nt, Artificial Sequence
  CXCR4 targeting guide RNA
uaaaagacugaccaauauug

SEQ ID NO: 5122 - RNA, 20 nt, Artificial Sequence
  CXCR4 targeting guide RNA
uaaacagcuggggaucauuu

SEQ ID NO: 5123 - RNA, 20 nt, Artificial Sequence
  CXCR4 targeting guide RNA
uaaagcuagaaaugaucccc

SEQ ID NO: 5124 - RNA, 20 nt, Artificial Sequence
  CXCR4 targeting guide RNA
uaaccaaagcccaaaguggu

SEQ ID NO: 5125 - RNA, 20 nt, Artificial Sequence
  CXCR4 targeting guide RNA
uaagaacaggaaaaacguuc

SEQ ID NO: 5126 - RNA, 20 nt, Artificial Sequence
  CXCR4 targeting guide RNA
uaagaacuuggccacagguc

SEQ ID NO: 5127 - RNA, 20 nt, Artificial Sequence
  CXCR4 targeting guide RNA
uaagacgugauuuugcugua

SEQ ID NO: 5128 - RNA, 20 nt, Artificial Sequence
  CXCR4 targeting guide RNA
uaagugccaucuucuacagc

SEQ ID NO: 5129 - RNA, 20 nt, Artificial Sequence
  CXCR4 targeting guide RNA
uaauacaagacuguacacug

SEQ ID NO: 5130 - RNA, 20 nt, Artificial Sequence
  CXCR4 targeting guide RNA
uaaucucuccauucccgugg

SEQ ID NO: 5131 - RNA, 20 nt, Artificial Sequence
  CXCR4 targeting guide RNA
uacaagacuguacacuguag

SEQ ID NO: 5132 - RNA, 20 nt, Artificial Sequence
  CXCR4 targeting guide RNA
uacaauauuggucagucuuu

SEQ ID NO: 5133 - RNA, 20 nt, Artificial Sequence
  CXCR4 targeting guide RNA
uacacgcucuggaauguuca

SEQ ID NO: 5134 - RNA, 20 nt, Artificial Sequence
  CXCR4 targeting guide RNA
uacacuguaggugcugaaau

SEQ ID NO: 5135 - RNA, 20 nt, Artificial Sequence
  CXCR4 targeting guide RNA
uacagcaaaaucacgucuua

SEQ ID NO: 5136 - RNA, 20 nt, Artificial Sequence
  CXCR4 targeting guide RNA
uacagcaacuaagaacuugg

SEQ ID NO: 5137 - RNA, 20 nt, Artificial Sequence
  CXCR4 targeting guide RNA
uacaguccuaccacgagaca

SEQ ID NO: 5138 - RNA, 20 nt, Artificial Sequence
  CXCR4 targeting guide RNA
uacagucuuguauuaaguug

SEQ ID NO: 5139 - RNA, 20 nt, Artificial Sequence
  CXCR4 targeting guide RNA
uacaguguacagucuuguau

SEQ ID NO: 5140 - RNA, 20 nt, Artificial Sequence
  CXCR4 targeting guide RNA
uaccacgagacauacagcaa

SEQ ID NO: 5141 - RNA, 20 nt, Artificial Sequence
  CXCR4 targeting guide RNA
uaccacuuugggcuuugguu

SEQ ID NO: 5142 - RNA, 20 nt, Artificial Sequence
  CXCR4 targeting guide RNA
uacgugauucacuacacgcu

SEQ ID NO: 5143 - RNA, 20 nt, Artificial Sequence
  CXCR4 targeting guide RNA
uagaaaagggaacugaacau

SEQ ID NO: 5144 - RNA, 20 nt, Artificial Sequence
  CXCR4 targeting guide RNA
uagaaaugauccccagcugu

SEQ ID NO: 5145 - RNA, 20 nt, Artificial Sequence
  CXCR4 targeting guide RNA
uagaaaugcugguuuuucag

SEQ ID NO: 5146 - RNA, 20 nt, Artificial Sequence
  CXCR4 targeting guide RNA
uagaagauggcacuuauaac

SEQ ID NO: 5147 - RNA, 20 nt, Artificial Sequence
  CXCR4 targeting guide RNA
uagacacacaucaauaugaa

SEQ ID NO: 5148 - RNA, 20 nt, Artificial Sequence
  CXCR4 targeting guide RNA
uagauaaucucuccauuccc

SEQ ID NO: 5149 - RNA, 20 nt, Artificial Sequence
  CXCR4 targeting guide RNA
uagcuuuacgugauucacua

SEQ ID NO: 5150 - RNA, 20 nt, Artificial Sequence
  CXCR4 targeting guide RNA
uaggacuguagaaaagggaa

SEQ ID NO: 5151 - RNA, 20 nt, Artificial Sequence
  CXCR4 targeting guide RNA
uaggcaggaccuguggccaa

SEQ ID NO: 5152 - RNA, 20 nt, Artificial Sequence
  CXCR4 targeting guide RNA
uaggugcugaaaucaaccca

SEQ ID NO: 5153 - RNA, 20 nt, Artificial Sequence
  CXCR4 targeting guide RNA
uagugaaucacguaaagcua

SEQ ID NO: 5154 - RNA, 20 nt, Artificial Sequence
  CXCR4 targeting guide RNA
uaguugcuguaugucucgug

SEQ ID NO: 5155 - RNA, 20 nt, Artificial Sequence
  CXCR4 targeting guide RNA
uauaaccaaagcccaaagug

SEQ ID NO: 5156 - RNA, 20 nt, Artificial Sequence
  CXCR4 targeting guide RNA
uauaagugccaucuucuaca

SEQ ID NO: 5157 - RNA, 20 nt, Artificial Sequence
  CXCR4 targeting guide RNA
uauaccacuuugggcuuugg

SEQ ID NO: 5158 - RNA, 20 nt, Artificial Sequence
  CXCR4 targeting guide RNA
uauagaaaugcugguuuuuc

SEQ ID NO: 5159 - RNA, 20 nt, Artificial Sequence
  CXCR4 targeting guide RNA
uaucuaugcauaaacagcug

SEQ ID NO: 5160 - RNA, 20 nt, Artificial Sequence
  CXCR4 targeting guide RNA
uaugcauaaacagcugggga

SEQ ID NO: 5161 - RNA, 20 nt, Artificial Sequence
  CXCR4 targeting guide RNA
uaugcauagauaaucucucc

SEQ ID NO: 5162 - RNA, 20 nt, Artificial Sequence
  CXCR4 targeting guide RNA
uaugucucgugguaggacug

SEQ ID NO: 5163 - RNA, 20 nt, Artificial Sequence
  CXCR4 targeting guide RNA
uauugaugugugucuaggca

SEQ ID NO: 5164 - RNA, 20 nt, Artificial Sequence
  CXCR4 targeting guide RNA
uauugcuuguuggauuuuug

SEQ ID NO: 5165 - RNA, 20 nt, Artificial Sequence
  CXCR4 targeting guide RNA
ucaacccacuccugaaaacu

SEQ ID NO: 5166 - RNA, 20 nt, Artificial Sequence
  CXCR4 targeting guide RNA
ucacguaaagcuagaaauga

SEQ ID NO: 5167 - RNA, 20 nt, Artificial Sequence
  CXCR4 targeting guide RNA
ucacgucuuaagaacaggaa

SEQ ID NO: 5168 - RNA, 20 nt, Artificial Sequence
  CXCR4 targeting guide RNA
ucacuacacgcucuggaaug

SEQ ID NO: 5169 - RNA, 20 nt, Artificial Sequence
  CXCR4 targeting guide RNA
ucagauauaaaagacugacc

SEQ ID NO: 5170 - RNA, 20 nt, Artificial Sequence
  CXCR4 targeting guide RNA
ucagcaccuacaguguacag

SEQ ID NO: 5171 - RNA, 20 nt, Artificial Sequence
  CXCR4 targeting guide RNA
ucaggaguggguugauuuca

SEQ ID NO: 5172 - RNA, 20 nt, Artificial Sequence
  CXCR4 targeting guide RNA
ucaguucccuuuucuacagu

SEQ ID NO: 5173 - RNA, 20 nt, Artificial Sequence
  CXCR4 targeting guide RNA
ucaguuuucaggaguggguu

SEQ ID NO: 5174 - RNA, 20 nt, Artificial Sequence
  CXCR4 targeting guide RNA
ucauauugaugugugucuag

SEQ ID NO: 5175 - RNA, 20 nt, Artificial Sequence
  CXCR4 targeting guide RNA
ucauuucuagcuuuacguga

SEQ ID NO: 5176 - RNA, 20 nt, Artificial Sequence
  CXCR4 targeting guide RNA
uccaacaagcaauaaaaacu

SEQ ID NO: 5177 - RNA, 20 nt, Artificial Sequence
  CXCR4 targeting guide RNA
uccacgggaauggagagauu

SEQ ID NO: 5178 - RNA, 20 nt, Artificial Sequence
  CXCR4 targeting guide RNA
uccagagcguguagugaauc

SEQ ID NO: 5179 - RNA, 20 nt, Artificial Sequence
  CXCR4 targeting guide RNA
uccauucccguggaacguuu

SEQ ID NO: 5180 - RNA, 20 nt, Artificial Sequence
  CXCR4 targeting guide RNA
uccccagcuguuuaugcaua

SEQ ID NO: 5181 - RNA, 20 nt, Artificial Sequence
  CXCR4 targeting guide RNA
ucccguggaacguuuuuccu

SEQ ID NO: 5182 - RNA, 20 nt, Artificial Sequence
  CXCR4 targeting guide RNA
ucccuuuucuacaguccuac

SEQ ID NO: 5183 - RNA, 20 nt, Artificial Sequence
  CXCR4 targeting guide RNA
uccuaccacgagacauacag

SEQ ID NO: 5184 - RNA, 20 nt, Artificial Sequence
  CXCR4 targeting guide RNA
uccugaaaacugaaaaacca

SEQ ID NO: 5185 - RNA, 20 nt, Artificial Sequence
  CXCR4 targeting guide RNA
uccugccuagacacacauca

SEQ ID NO: 5186 - RNA, 20 nt, Artificial Sequence
  CXCR4 targeting guide RNA
uccuguucuuaagacgugau

SEQ ID NO: 5187 - RNA, 20 nt, Artificial Sequence
  CXCR4 targeting guide RNA
ucgugguaggacuguagaaa

SEQ ID NO: 5188 - RNA, 20 nt, Artificial Sequence
  CXCR4 targeting guide RNA
ucuacagcaaaaucacgucu

SEQ ID NO: 5189 - RNA, 20 nt, Artificial Sequence
  CXCR4 targeting guide RNA
ucuacaguccuaccacgaga

SEQ ID NO: 5190 - RNA, 20 nt, Artificial Sequence
  CXCR4 targeting guide RNA
ucuagcuuuacgugauucac

SEQ ID NO: 5191 - RNA, 20 nt, Artificial Sequence
  CXCR4 targeting guide RNA
ucuaggcaggaccuguggcc

SEQ ID NO: 5192 - RNA, 20 nt, Artificial Sequence
  CXCR4 targeting guide RNA
ucuauaccacuuugggcuuu

SEQ ID NO: 5193 - RNA, 20 nt, Artificial Sequence
  CXCR4 targeting guide RNA
ucuaugcauaaacagcuggg

SEQ ID NO: 5194 - RNA, 20 nt, Artificial Sequence
  CXCR4 targeting guide RNA
ucuccauucccguggaacgu

SEQ ID NO: 5195 - RNA, 20 nt, Artificial Sequence
  CXCR4 targeting guide RNA
ucucgugguaggacuguaga

SEQ ID NO: 5196 - RNA, 20 nt, Artificial Sequence
  CXCR4 targeting guide RNA
ucucuccauucccguggaac

SEQ ID NO: 5197 - RNA, 20 nt, Artificial Sequence
  CXCR4 targeting guide RNA
ucuggaauguucaguucccu

SEQ ID NO: 5198 - RNA, 20 nt, Artificial Sequence
  CXCR4 targeting guide RNA
ucuuaagaacaggaaaaacg

SEQ ID NO: 5199 - RNA, 20 nt, Artificial Sequence
  CXCR4 targeting guide RNA
ucuuaagacgugauuuugcu

SEQ ID NO: 5200 - RNA, 20 nt, Artificial Sequence
  CXCR4 targeting guide RNA
ucuuaguugcuguaugucuc

SEQ ID NO: 5201 - RNA, 20 nt, Artificial Sequence
  CXCR4 targeting guide RNA
ucuucuacagcaaaaucacg

SEQ ID NO: 5202 - RNA, 20 nt, Artificial Sequence
  CXCR4 targeting guide RNA
ugaaaaaccagcauuucuau

SEQ ID NO: 5203 - RNA, 20 nt, Artificial Sequence
  CXCR4 targeting guide RNA
ugaaaacugaaaaaccagca

SEQ ID NO: 5204 - RNA, 20 nt, Artificial Sequence
  CXCR4 targeting guide RNA
ugaaaucaacccacuccuga

SEQ ID NO: 5205 - RNA, 20 nt, Artificial Sequence
  CXCR4 targeting guide RNA
ugaacauuccagagcgugua

SEQ ID NO: 5206 - RNA, 20 nt, Artificial Sequence
  CXCR4 targeting guide RNA
ugaaucacguaaagcuagaa

SEQ ID NO: 5207 - RNA, 20 nt, Artificial Sequence
  CXCR4 targeting guide RNA
ugaccaauauuguacaguuu

SEQ ID NO: 5208 - RNA, 20 nt, Artificial Sequence
  CXCR4 targeting guide RNA
ugauccccagcuguuuaugc

SEQ ID NO: 5209 - RNA, 20 nt, Artificial Sequence
  CXCR4 targeting guide RNA
ugaugugugucuaggcagga

SEQ ID NO: 5210 - RNA, 20 nt, Artificial Sequence
  CXCR4 targeting guide RNA
ugauucacuacacgcucugg

SEQ ID NO: 5211 - RNA, 20 nt, Artificial Sequence
  CXCR4 targeting guide RNA
ugauuucagcaccuacagug

SEQ ID NO: 5212 - RNA, 20 nt, Artificial Sequence
  CXCR4 targeting guide RNA
ugauuuugcuguagaagaug

SEQ ID NO: 5213 - RNA, 20 nt, Artificial Sequence
  CXCR4 targeting guide RNA
ugcauaaacagcuggggauc

SEQ ID NO: 5214 - RNA, 20 nt, Artificial Sequence
  CXCR4 targeting guide RNA
ugcauagauaaucucuccau

SEQ ID NO: 5215 - RNA, 20 nt, Artificial Sequence
  CXCR4 targeting guide RNA
ugccaucuucuacagcaaaa

SEQ ID NO: 5216 - RNA, 20 nt, Artificial Sequence
  CXCR4 targeting guide RNA
ugccuagacacacaucaaua

SEQ ID NO: 5217 - RNA, 20 nt, Artificial Sequence
  CXCR4 targeting guide RNA
ugcugaaaucaacccacucc

SEQ ID NO: 5218 - RNA, 20 nt, Artificial Sequence
  CXCR4 targeting guide RNA
ugcugguuuuucaguuuuca

SEQ ID NO: 5219 - RNA, 20 nt, Artificial Sequence
  CXCR4 targeting guide RNA
ugcuguagaagauggcacuu

SEQ ID NO: 5220 - RNA, 20 nt, Artificial Sequence
  CXCR4 targeting guide RNA
ugcuguaugucucgugguag

SEQ ID NO: 5221 - RNA, 20 nt, Artificial Sequence
  CXCR4 targeting guide RNA
ugcuuguuggauuuuugucu

SEQ ID NO: 5222 - RNA, 20 nt, Artificial Sequence
  CXCR4 targeting guide RNA
uggaacguuuuuccuguucu

SEQ ID NO: 5223 - RNA, 20 nt, Artificial Sequence
  CXCR4 targeting guide RNA
uggaauguucaguucccuuu

SEQ ID NO: 5224 - RNA, 20 nt, Artificial Sequence
  CXCR4 targeting guide RNA
uggagagauuaucuaugcau

SEQ ID NO: 5225 - RNA, 20 nt, Artificial Sequence
  CXCR4 targeting guide RNA
uggauuuuugucuuguguuu

SEQ ID NO: 5226 - RNA, 20 nt, Artificial Sequence
  CXCR4 targeting guide RNA
uggcacuuauaaccaaagcc

SEQ ID NO: 5227 - RNA, 20 nt, Artificial Sequence
  CXCR4 targeting guide RNA
uggccaaguucuuaguugcu

SEQ ID NO: 5228 - RNA, 20 nt, Artificial Sequence
  CXCR4 targeting guide RNA
uggccacagguccugccuag

SEQ ID NO: 5229 - RNA, 20 nt, Artificial Sequence
  CXCR4 targeting guide RNA
ugggcuuugguuauaagugc

SEQ ID NO: 5230 - RNA, 20 nt, Artificial Sequence
  CXCR4 targeting guide RNA
uggggaucauuucuagcuuu

SEQ ID NO: 5231 - RNA, 20 nt, Artificial Sequence
  CXCR4 targeting guide RNA
uggguugauuucagcaccua

SEQ ID NO: 5232 - RNA, 20 nt, Artificial Sequence
  CXCR4 targeting guide RNA
ugguaggacuguagaaaagg

SEQ ID NO: 5233 - RNA, 20 nt, Artificial Sequence
  CXCR4 targeting guide RNA
ugguauagaaaugcugguuu

SEQ ID NO: 5234 - RNA, 20 nt, Artificial Sequence
  CXCR4 targeting guide RNA
uggucagucuuuuauaucug

SEQ ID NO: 5235 - RNA, 20 nt, Artificial Sequence
  CXCR4 targeting guide RNA
ugguuauaagugccaucuuc

SEQ ID NO: 5236 - RNA, 20 nt, Artificial Sequence
  CXCR4 targeting guide RNA
ugguuuuucaguuuucagga

SEQ ID NO: 5237 - RNA, 20 nt, Artificial Sequence
  CXCR4 targeting guide RNA
uguacaauauuggucagucu

SEQ ID NO: 5238 - RNA, 20 nt, Artificial Sequence
  CXCR4 targeting guide RNA
uguacacuguaggugcugaa

SEQ ID NO: 5239 - RNA, 20 nt, Artificial Sequence
  CXCR4 targeting guide RNA
uguacagucuuguauuaagu

SEQ ID NO: 5240 - RNA, 20 nt, Artificial Sequence
  CXCR4 targeting guide RNA
uguacaguuuuuauugcuug

SEQ ID NO: 5241 - RNA, 20 nt, Artificial Sequence
  CXCR4 targeting guide RNA
uguagaaaagggaacugaac

SEQ ID NO: 5242 - RNA, 20 nt, Artificial Sequence
  CXCR4 targeting guide RNA
uguagaagauggcacuuaua

SEQ ID NO: 5243 - RNA, 20 nt, Artificial Sequence
  CXCR4 targeting guide RNA
uguaggugcugaaaucaacc

SEQ ID NO: 5244 - RNA, 20 nt, Artificial Sequence
  CXCR4 targeting guide RNA
uguagugaaucacguaaagc

SEQ ID NO: 5245 - RNA, 20 nt, Artificial Sequence
  CXCR4 targeting guide RNA
uguaugucucgugguaggac

SEQ ID NO: 5246 - RNA, 20 nt, Artificial Sequence
  CXCR4 targeting guide RNA
ugucuaggcaggaccugugg

SEQ ID NO: 5247 - RNA, 20 nt, Artificial Sequence
  CXCR4 targeting guide RNA
ugucucgugguaggacugua

SEQ ID NO: 5248 - RNA, 20 nt, Artificial Sequence
  CXCR4 targeting guide RNA
ugucuuguguuucuuuaguu

SEQ ID NO: 5249 - RNA, 20 nt, Artificial Sequence
  CXCR4 targeting guide RNA
uguggccaaguucuuaguug

SEQ ID NO: 5250 - RNA, 20 nt, Artificial Sequence
  CXCR4 targeting guide RNA
ugugucuaggcaggaccugu

SEQ ID NO: 5251 - RNA, 20 nt, Artificial Sequence
  CXCR4 targeting guide RNA
ugugugucuaggcaggaccu

SEQ ID NO: 5252 - RNA, 20 nt, Artificial Sequence
  CXCR4 targeting guide RNA
uguucaguucccuuuucuac

SEQ ID NO: 5253 - RNA, 20 nt, Artificial Sequence
  CXCR4 targeting guide RNA
uguucuuaagacgugauuuu

SEQ ID NO: 5254 - RNA, 20 nt, Artificial Sequence
  CXCR4 targeting guide RNA
uguuggauuuuugucuugug

SEQ ID NO: 5255 - RNA, 20 nt, Artificial Sequence
  CXCR4 targeting guide RNA
uguuucauauugaugugugu

SEQ ID NO: 5256 - RNA, 20 nt, Artificial Sequence
  CXCR4 targeting guide RNA
uuaagaacaggaaaaacguu

SEQ ID NO: 5257 - RNA, 20 nt, Artificial Sequence
  CXCR4 targeting guide RNA
uuaagacgugauuuugcugu

SEQ ID NO: 5258 - RNA, 20 nt, Artificial Sequence
  CXCR4 targeting guide RNA
uuaauacaagacuguacacu

SEQ ID NO: 5259 - RNA, 20 nt, Artificial Sequence
  CXCR4 targeting guide RNA
uuacgugauucacuacacgc

SEQ ID NO: 5260 - RNA, 20 nt, Artificial Sequence
  CXCR4 targeting guide RNA
uuaguugcuguaugucucgu

SEQ ID NO: 5261 - RNA, 20 nt, Artificial Sequence
  CXCR4 targeting guide RNA
uuauaaccaaagcccaaagu

SEQ ID NO: 5262 - RNA, 20 nt, Artificial Sequence
  CXCR4 targeting guide RNA
uuauaagugccaucuucuac

SEQ ID NO: 5263 - RNA, 20 nt, Artificial Sequence
  CXCR4 targeting guide RNA
uuaucuaugcauaaacagcu

SEQ ID NO: 5264 - RNA, 20 nt, Artificial Sequence
  CXCR4 targeting guide RNA
uuaugcauagauaaucucuc

SEQ ID NO: 5265 - RNA, 20 nt, Artificial Sequence
  CXCR4 targeting guide RNA
uucacuacacgcucuggaau

SEQ ID NO: 5266 - RNA, 20 nt, Artificial Sequence
  CXCR4 targeting guide RNA
uucagauauaaaagacugac

SEQ ID NO: 5267 - RNA, 20 nt, Artificial Sequence
  CXCR4 targeting guide RNA
uucagcaccuacaguguaca

SEQ ID NO: 5268 - RNA, 20 nt, Artificial Sequence
  CXCR4 targeting guide RNA
uucaggaguggguugauuuc

SEQ ID NO: 5269 - RNA, 20 nt, Artificial Sequence
  CXCR4 targeting guide RNA
uucaguucccuuuucuacag

SEQ ID NO: 5270 - RNA, 20 nt, Artificial Sequence
  CXCR4 targeting guide RNA
uucaguuuucaggagugggu

SEQ ID NO: 5271 - RNA, 20 nt, Artificial Sequence
  CXCR4 targeting guide RNA
uucauauugaugugugucua

SEQ ID NO: 5272 - RNA, 20 nt, Artificial Sequence
  CXCR4 targeting guide RNA
uuccacgggaauggagagau

SEQ ID NO: 5273 - RNA, 20 nt, Artificial Sequence
  CXCR4 targeting guide RNA
uuccagagcguguagugaau

SEQ ID NO: 5274 - RNA, 20 nt, Artificial Sequence
  CXCR4 targeting guide RNA
uucccguggaacguuuuucc

SEQ ID NO: 5275 - RNA, 20 nt, Artificial Sequence
  CXCR4 targeting guide RNA
uucccuuuucuacaguccua

SEQ ID NO: 5276 - RNA, 20 nt, Artificial Sequence
  CXCR4 targeting guide RNA
uuccuguucuuaagacguga

SEQ ID NO: 5277 - RNA, 20 nt, Artificial Sequence
  CXCR4 targeting guide RNA
uucuacagcaaaaucacguc

SEQ ID NO: 5278 - RNA, 20 nt, Artificial Sequence
  CXCR4 targeting guide RNA
uucuacaguccuaccacgag

SEQ ID NO: 5279 - RNA, 20 nt, Artificial Sequence
  CXCR4 targeting guide RNA
uucuagcuuuacgugauuca

SEQ ID NO: 5280 - RNA, 20 nt, Artificial Sequence
  CXCR4 targeting guide RNA
uucuauaccacuuugggcuu

SEQ ID NO: 5281 - RNA, 20 nt, Artificial Sequence
  CXCR4 targeting guide RNA
uucuuaagacgugauuuugc

SEQ ID NO: 5282 - RNA, 20 nt, Artificial Sequence
  CXCR4 targeting guide RNA
uucuuaguugcuguaugucu

SEQ ID NO: 5283 - RNA, 20 nt, Artificial Sequence
  CXCR4 targeting guide RNA
uugaugugugucuaggcagg

SEQ ID NO: 5284 - RNA, 20 nt, Artificial Sequence
  CXCR4 targeting guide RNA
uugauuucagcaccuacagu

SEQ ID NO: 5285 - RNA, 20 nt, Artificial Sequence
  CXCR4 targeting guide RNA
uugcuguagaagauggcacu

SEQ ID NO: 5286 - RNA, 20 nt, Artificial Sequence
  CXCR4 targeting guide RNA
uugcuguaugucucguggua

SEQ ID NO: 5287 - RNA, 20 nt, Artificial Sequence
  CXCR4 targeting guide RNA
uugcuuguuggauuuuuguc

SEQ ID NO: 5288 - RNA, 20 nt, Artificial Sequence
  CXCR4 targeting guide RNA
uuggauuuuugucuuguguu

SEQ ID NO: 5289 - RNA, 20 nt, Artificial Sequence
  CXCR4 targeting guide RNA
uuggccacagguccugccua

SEQ ID NO: 5290 - RNA, 20 nt, Artificial Sequence
  CXCR4 targeting guide RNA
uugggcuuugguuauaagug

SEQ ID NO: 5291 - RNA, 20 nt, Artificial Sequence
  CXCR4 targeting guide RNA
uuggucagucuuuuauaucu

SEQ ID NO: 5292 - RNA, 20 nt, Artificial Sequence
  CXCR4 targeting guide RNA
uugguuauaagugccaucuu

SEQ ID NO: 5293 - RNA, 20 nt, Artificial Sequence
  CXCR4 targeting guide RNA
uugucuuguguuucuuuagu

SEQ ID NO: 5294 - RNA, 20 nt, Artificial Sequence
  CXCR4 targeting guide RNA
uuguuggauuuuugucuugu

SEQ ID NO: 5295 - RNA, 20 nt, Artificial Sequence
  CXCR4 targeting guide RNA
uuguuucauauugaugugug

SEQ ID NO: 5296 - RNA, 20 nt, Artificial Sequence
  CXCR4 targeting guide RNA
uuuacgugauucacuacacg

SEQ ID NO: 5297 - RNA, 20 nt, Artificial Sequence
  CXCR4 targeting guide RNA
uuucagcaccuacaguguac

SEQ ID NO: 5298 - RNA, 20 nt, Artificial Sequence
  CXCR4 targeting guide RNA
uuucaggaguggguugauuu

SEQ ID NO: 5299 - RNA, 20 nt, Artificial Sequence
  CXCR4 targeting guide RNA
uuucaguuuucaggaguggg

SEQ ID NO: 5300 - RNA, 20 nt, Artificial Sequence
  CXCR4 targeting guide RNA
uuucauauugaugugugucu

SEQ ID NO: 5301 - RNA, 20 nt, Artificial Sequence
  CXCR4 targeting guide RNA
uuuccuguucuuaagacgug

SEQ ID NO: 5302 - RNA, 20 nt, Artificial Sequence
  CXCR4 targeting guide RNA
uuucuacaguccuaccacga

SEQ ID NO: 5303 - RNA, 20 nt, Artificial Sequence
  CXCR4 targeting guide RNA
uuucuagcuuuacgugauuc

SEQ ID NO: 5304 - RNA, 20 nt, Artificial Sequence
  CXCR4 targeting guide RNA
uuucuauaccacuuugggcu

SEQ ID NO: 5305 - RNA, 20 nt, Artificial Sequence
  CXCR4 targeting guide RNA
uuugcuguagaagauggcac

SEQ ID NO: 5306 - RNA, 20 nt, Artificial Sequence
  CXCR4 targeting guide RNA
uuugggcuuugguuauaagu

SEQ ID NO: 5307 - RNA, 20 nt, Artificial Sequence
  CXCR4 targeting guide RNA
uuugguuauaagugccaucu

SEQ ID NO: 5308 - RNA, 20 nt, Artificial Sequence
  CXCR4 targeting guide RNA
uuugucuuguguuucuuuag

SEQ ID NO: 5309 - RNA, 20 nt, Artificial Sequence
  CXCR4 targeting guide RNA
uuuucaggaguggguugauu

SEQ ID NO: 5310 - RNA, 20 nt, Artificial Sequence
  CXCR4 targeting guide RNA
uuuucaguuuucaggagugg

SEQ ID NO: 5311 - RNA, 20 nt, Artificial Sequence
  CXCR4 targeting guide RNA
uuuuccuguucuuaagacgu

SEQ ID NO: 5312 - RNA, 20 nt, Artificial Sequence
  CXCR4 targeting guide RNA
uuuucuacaguccuaccacg

SEQ ID NO: 5313 - RNA, 20 nt, Artificial Sequence
  CXCR4 targeting guide RNA
uuuugcuguagaagauggca

SEQ ID NO: 5314 - RNA, 20 nt, Artificial Sequence
  CXCR4 targeting guide RNA
uuuuucaguuuucaggagug

SEQ ID NO: 5315 - RNA, 20 nt, Artificial Sequence
  CXCR4 targeting guide RNA
uuuuuccuguucuuaagacg

SEQ ID NO: 5316 - RNA, 21 nt, Artificial Sequence
  CXCR4 targeting guide RNA
aaaaaccagcauuucuauacc

SEQ ID NO: 5317 - RNA, 21 nt, Artificial Sequence
  CXCR4 targeting guide RNA
aaaaacguuccacgggaaugg

SEQ ID NO: 5318 - RNA, 21 nt, Artificial Sequence
  CXCR4 targeting guide RNA
aaaaccagcauuucuauacca

SEQ ID NO: 5319 - RNA, 21 nt, Artificial Sequence
  CXCR4 targeting guide RNA
aaaacguuccacgggaaugga

SEQ ID NO: 5320 - RNA, 21 nt, Artificial Sequence
  CXCR4 targeting guide RNA
aaaagggaacugaacauucca

SEQ ID NO: 5321 - RNA, 21 nt, Artificial Sequence
  CXCR4 targeting guide RNA
aaaaucacgucuuaagaacag

SEQ ID NO: 5322 - RNA, 21 nt, Artificial Sequence
  CXCR4 targeting guide RNA
aaacagcuggggaucauuucu

SEQ ID NO: 5323 - RNA, 21 nt, Artificial Sequence
  CXCR4 targeting guide RNA
aaaccagcauuucuauaccac

SEQ ID NO: 5324 - RNA, 21 nt, Artificial Sequence
  CXCR4 targeting guide RNA
aaacguuccacgggaauggag

SEQ ID NO: 5325 - RNA, 21 nt, Artificial Sequence
  CXCR4 targeting guide RNA
aaacugaaaaaccagcauuuc

SEQ ID NO: 5326 - RNA, 21 nt, Artificial Sequence
  CXCR4 targeting guide RNA
aaacuguacaauauuggucag

SEQ ID NO: 5327 - RNA, 21 nt, Artificial Sequence
  CXCR4 targeting guide RNA
aaagacugaccaauauuguac

SEQ ID NO: 5328 - RNA, 21 nt, Artificial Sequence
  CXCR4 targeting guide RNA
aaagcccaaagugguauagaa

SEQ ID NO: 5329 - RNA, 21 nt, Artificial Sequence
  CXCR4 targeting guide RNA
aaagcuagaaaugauccccag

SEQ ID NO: 5330 - RNA, 21 nt, Artificial Sequence
  CXCR4 targeting guide RNA
aaagggaacugaacauuccag

SEQ ID NO: 5331 - RNA, 21 nt, Artificial Sequence
  CXCR4 targeting guide RNA
aaagugguauagaaaugcugg

SEQ ID NO: 5332 - RNA, 21 nt, Artificial Sequence
  CXCR4 targeting guide RNA
aaaucaacccacuccugaaaa

SEQ ID NO: 5333 - RNA, 21 nt, Artificial Sequence
  CXCR4 targeting guide RNA
aaaucacgucuuaagaacagg

SEQ ID NO: 5334 - RNA, 21 nt, Artificial Sequence
  CXCR4 targeting guide RNA
aaaugauccccagcuguuuau

SEQ ID NO: 5335 - RNA, 21 nt, Artificial Sequence
  CXCR4 targeting guide RNA
aacacaagacaaaaauccaac

SEQ ID NO: 5336 - RNA, 21 nt, Artificial Sequence
  CXCR4 targeting guide RNA
aacagcuggggaucauuucua

SEQ ID NO: 5337 - RNA, 21 nt, Artificial Sequence
  CXCR4 targeting guide RNA
aacaggaaaaacguuccacgg

SEQ ID NO: 5338 - RNA, 21 nt, Artificial Sequence
  CXCR4 targeting guide RNA
aacauuccagagcguguagug

SEQ ID NO: 5339 - RNA, 21 nt, Artificial Sequence
  CXCR4 targeting guide RNA
aaccaaagcccaaagugguau

SEQ ID NO: 5340 - RNA, 21 nt, Artificial Sequence
  CXCR4 targeting guide RNA
aaccagcauuucuauaccacu

SEQ ID NO: 5341 - RNA, 21 nt, Artificial Sequence
  CXCR4 targeting guide RNA
aacccacuccugaaaacugaa

SEQ ID NO: 5342 - RNA, 21 nt, Artificial Sequence
  CXCR4 targeting guide RNA
aacguuccacgggaauggaga

SEQ ID NO: 5343 - RNA, 21 nt, Artificial Sequence
  CXCR4 targeting guide RNA
aacguuuuuccuguucuuaag

SEQ ID NO: 5344 - RNA, 21 nt, Artificial Sequence
  CXCR4 targeting guide RNA
aacuaagaacuuggccacagg

SEQ ID NO: 5345 - RNA, 21 nt, Artificial Sequence
  CXCR4 targeting guide RNA
aacugaaaaaccagcauuucu

SEQ ID NO: 5346 - RNA, 21 nt, Artificial Sequence
  CXCR4 targeting guide RNA
aacugaacauuccagagcgug

SEQ ID NO: 5347 - RNA, 21 nt, Artificial Sequence
  CXCR4 targeting guide RNA
aacuguacaauauuggucagu

SEQ ID NO: 5348 - RNA, 21 nt, Artificial Sequence
  CXCR4 targeting guide RNA
aacuuggccacagguccugcc

SEQ ID NO: 5349 - RNA, 21 nt, Artificial Sequence
  CXCR4 targeting guide RNA
aagaacaggaaaaacguucca

SEQ ID NO: 5350 - RNA, 21 nt, Artificial Sequence
  CXCR4 targeting guide RNA
aagaacuuggccacagguccu

SEQ ID NO: 5351 - RNA, 21 nt, Artificial Sequence
  CXCR4 targeting guide RNA
aagacaaaaauccaacaagca

SEQ ID NO: 5352 - RNA, 21 nt, Artificial Sequence
  CXCR4 targeting guide RNA
aagacgugauuuugcuguaga

SEQ ID NO: 5353 - RNA, 21 nt, Artificial Sequence
  CXCR4 targeting guide RNA
aagacugaccaauauuguaca

SEQ ID NO: 5354 - RNA, 21 nt, Artificial Sequence
  CXCR4 targeting guide RNA
aagacuguacacuguaggugc

SEQ ID NO: 5355 - RNA, 21 nt, Artificial Sequence
  CXCR4 targeting guide RNA
aagauggcacuuauaaccaaa

SEQ ID NO: 5356 - RNA, 21 nt, Artificial Sequence
  CXCR4 targeting guide RNA
aagcccaaagugguauagaaa

SEQ ID NO: 5357 - RNA, 21 nt, Artificial Sequence
  CXCR4 targeting guide RNA
aagcuagaaaugauccccagc

SEQ ID NO: 5358 - RNA, 21 nt, Artificial Sequence
  CXCR4 targeting guide RNA
aagggaacugaacauuccaga

SEQ ID NO: 5359 - RNA, 21 nt, Artificial Sequence
  CXCR4 targeting guide RNA
aagugccaucuucuacagcaa

SEQ ID NO: 5360 - RNA, 21 nt, Artificial Sequence
  CXCR4 targeting guide RNA
aagugguauagaaaugcuggu

SEQ ID NO: 5361 - RNA, 21 nt, Artificial Sequence
  CXCR4 targeting guide RNA
aaguucuuaguugcuguaugu

SEQ ID NO: 5362 - RNA, 21 nt, Artificial Sequence
  CXCR4 targeting guide RNA
aauacaagacuguacacugua

SEQ ID NO: 5363 - RNA, 21 nt, Artificial Sequence
  CXCR4 targeting guide RNA
aaucaacccacuccugaaaac

SEQ ID NO: 5364 - RNA, 21 nt, Artificial Sequence
  CXCR4 targeting guide RNA
aaucacguaaagcuagaaaug

SEQ ID NO: 5365 - RNA, 21 nt, Artificial Sequence
  CXCR4 targeting guide RNA
aaucacgucuuaagaacagga

SEQ ID NO: 5366 - RNA, 21 nt, Artificial Sequence
  CXCR4 targeting guide RNA
aaucucuccauucccguggaa

SEQ ID NO: 5367 - RNA, 21 nt, Artificial Sequence
  CXCR4 targeting guide RNA
aaugauccccagcuguuuaug

SEQ ID NO: 5368 - RNA, 21 nt, Artificial Sequence
  CXCR4 targeting guide RNA
aaugcugguuuuucaguuuuc

SEQ ID NO: 5369 - RNA, 21 nt, Artificial Sequence
  CXCR4 targeting guide RNA
aauggagagauuaucuaugca

SEQ ID NO: 5370 - RNA, 21 nt, Artificial Sequence
  CXCR4 targeting guide RNA
aauguucaguucccuuuucua

SEQ ID NO: 5371 - RNA, 21 nt, Artificial Sequence
  CXCR4 targeting guide RNA
acaagacaaaaauccaacaag

SEQ ID NO: 5372 - RNA, 21 nt, Artificial Sequence
  CXCR4 targeting guide RNA
acaagacuguacacuguaggu

SEQ ID NO: 5373 - RNA, 21 nt, Artificial Sequence
  CXCR4 targeting guide RNA
acacaagacaaaaauccaaca

SEQ ID NO: 5374 - RNA, 21 nt, Artificial Sequence
  CXCR4 targeting guide RNA
acacgcucuggaauguucagu

SEQ ID NO: 5375 - RNA, 21 nt, Artificial Sequence
  CXCR4 targeting guide RNA
acacuguaggugcugaaauca

SEQ ID NO: 5376 - RNA, 21 nt, Artificial Sequence
  CXCR4 targeting guide RNA
acagcaaaaucacgucuuaag

SEQ ID NO: 5377 - RNA, 21 nt, Artificial Sequence
  CXCR4 targeting guide RNA
acagcaacuaagaacuuggcc

SEQ ID NO: 5378 - RNA, 21 nt, Artificial Sequence
  CXCR4 targeting guide RNA
acagcuggggaucauuucuag

SEQ ID NO: 5379 - RNA, 21 nt, Artificial Sequence
  CXCR4 targeting guide RNA
acaggaaaaacguuccacggg

SEQ ID NO: 5380 - RNA, 21 nt, Artificial Sequence
  CXCR4 targeting guide RNA
acagguccugccuagacacac

SEQ ID NO: 5381 - RNA, 21 nt, Artificial Sequence
  CXCR4 targeting guide RNA
acaguccuaccacgagacaua

SEQ ID NO: 5382 - RNA, 21 nt, Artificial Sequence
  CXCR4 targeting guide RNA
acaguguacagucuuguauua

SEQ ID NO: 5383 - RNA, 21 nt, Artificial Sequence
  CXCR4 targeting guide RNA
acaguuuuuauugcuuguugg

SEQ ID NO: 5384 - RNA, 21 nt, Artificial Sequence
  CXCR4 targeting guide RNA
acauacagcaacuaagaacuu

SEQ ID NO: 5385 - RNA, 21 nt, Artificial Sequence
  CXCR4 targeting guide RNA
acauuccagagcguguaguga

SEQ ID NO: 5386 - RNA, 21 nt, Artificial Sequence
  CXCR4 targeting guide RNA
accaaagcccaaagugguaua

SEQ ID NO: 5387 - RNA, 21 nt, Artificial Sequence
  CXCR4 targeting guide RNA
accacgagacauacagcaacu

SEQ ID NO: 5388 - RNA, 21 nt, Artificial Sequence
  CXCR4 targeting guide RNA
accacuuugggcuuugguuau

SEQ ID NO: 5389 - RNA, 21 nt, Artificial Sequence
  CXCR4 targeting guide RNA
accagcauuucuauaccacuu

SEQ ID NO: 5390 - RNA, 21 nt, Artificial Sequence
  CXCR4 targeting guide RNA
acccacuccugaaaacugaaa

SEQ ID NO: 5391 - RNA, 21 nt, Artificial Sequence
  CXCR4 targeting guide RNA
accuacaguguacagucuugu

SEQ ID NO: 5392 - RNA, 21 nt, Artificial Sequence
  CXCR4 targeting guide RNA
accuguggccaaguucuuagu

SEQ ID NO: 5393 - RNA, 21 nt, Artificial Sequence
  CXCR4 targeting guide RNA
acgagacauacagcaacuaag

SEQ ID NO: 5394 - RNA, 21 nt, Artificial Sequence
  CXCR4 targeting guide RNA
acgcucuggaauguucaguuc

SEQ ID NO: 5395 - RNA, 21 nt, Artificial Sequence
  CXCR4 targeting guide RNA
acgggaauggagagauuaucu

SEQ ID NO: 5396 - RNA, 21 nt, Artificial Sequence
  CXCR4 targeting guide RNA
acguaaagcuagaaaugaucc

SEQ ID NO: 5397 - RNA, 21 nt, Artificial Sequence
  CXCR4 targeting guide RNA
acgucuuaagaacaggaaaaa

SEQ ID NO: 5398 - RNA, 21 nt, Artificial Sequence
  CXCR4 targeting guide RNA
acgugauucacuacacgcucu

SEQ ID NO: 5399 - RNA, 21 nt, Artificial Sequence
  CXCR4 targeting guide RNA
acgugauuuugcuguagaaga

SEQ ID NO: 5400 - RNA, 21 nt, Artificial Sequence
  CXCR4 targeting guide RNA
acguuccacgggaauggagag

SEQ ID NO: 5401 - RNA, 21 nt, Artificial Sequence
  CXCR4 targeting guide RNA
acguuuuuccuguucuuaaga

SEQ ID NO: 5402 - RNA, 21 nt, Artificial Sequence
  CXCR4 targeting guide RNA
acuaagaacuuggccacaggu

SEQ ID NO: 5403 - RNA, 21 nt, Artificial Sequence
  CXCR4 targeting guide RNA
acuacacgcucuggaauguuc

SEQ ID NO: 5404 - RNA, 21 nt, Artificial Sequence
  CXCR4 targeting guide RNA
acuccugaaaacugaaaaacc

SEQ ID NO: 5405 - RNA, 21 nt, Artificial Sequence
  CXCR4 targeting guide RNA
acugaaaaaccagcauuucua

SEQ ID NO: 5406 - RNA, 21 nt, Artificial Sequence
  CXCR4 targeting guide RNA
acugaacauuccagagcgugu

SEQ ID NO: 5407 - RNA, 21 nt, Artificial Sequence
  CXCR4 targeting guide RNA
acugaccaauauuguacaguu

SEQ ID NO: 5408 - RNA, 21 nt, Artificial Sequence
  CXCR4 targeting guide RNA
acuguacaauauuggucaguc

SEQ ID NO: 5409 - RNA, 21 nt, Artificial Sequence
  CXCR4 targeting guide RNA
acuguacacuguaggugcuga

SEQ ID NO: 5410 - RNA, 21 nt, Artificial Sequence
  CXCR4 targeting guide RNA
acuguagaaaagggaacugaa

SEQ ID NO: 5411 - RNA, 21 nt, Artificial Sequence
  CXCR4 targeting guide RNA
acuguaggugcugaaaucaac

SEQ ID NO: 5412 - RNA, 21 nt, Artificial Sequence
  CXCR4 targeting guide RNA
acuuaauacaagacuguacac

SEQ ID NO: 5413 - RNA, 21 nt, Artificial Sequence
  CXCR4 targeting guide RNA
acuuauaaccaaagcccaaag

SEQ ID NO: 5414 - RNA, 21 nt, Artificial Sequence
  CXCR4 targeting guide RNA
acuuggccacagguccugccu

SEQ ID NO: 5415 - RNA, 21 nt, Artificial Sequence
  CXCR4 targeting guide RNA
acuuugggcuuugguuauaag

SEQ ID NO: 5416 - RNA, 21 nt, Artificial Sequence
  CXCR4 targeting guide RNA
agaaaagggaacugaacauuc

SEQ ID NO: 5417 - RNA, 21 nt, Artificial Sequence
  CXCR4 targeting guide RNA
agaaacacaagacaaaaaucc

SEQ ID NO: 5418 - RNA, 21 nt, Artificial Sequence
  CXCR4 targeting guide RNA
agaaaugauccccagcuguuu

SEQ ID NO: 5419 - RNA, 21 nt, Artificial Sequence
  CXCR4 targeting guide RNA
agaaaugcugguuuuucaguu

SEQ ID NO: 5420 - RNA, 21 nt, Artificial Sequence
  CXCR4 targeting guide RNA
agaacaggaaaaacguuccac

SEQ ID NO: 5421 - RNA, 21 nt, Artificial Sequence
  CXCR4 targeting guide RNA
agaacuuggccacagguccug

SEQ ID NO: 5422 - RNA, 21 nt, Artificial Sequence
  CXCR4 targeting guide RNA
agaagauggcacuuauaacca

SEQ ID NO: 5423 - RNA, 21 nt, Artificial Sequence
  CXCR4 targeting guide RNA
agacaaaaauccaacaagcaa

SEQ ID NO: 5424 - RNA, 21 nt, Artificial Sequence
  CXCR4 targeting guide RNA
agacacacaucaauaugaaac

SEQ ID NO: 5425 - RNA, 21 nt, Artificial Sequence
  CXCR4 targeting guide RNA
agacauacagcaacuaagaac

SEQ ID NO: 5426 - RNA, 21 nt, Artificial Sequence
  CXCR4 targeting guide RNA
agacgugauuuugcuguagaa

SEQ ID NO: 5427 - RNA, 21 nt, Artificial Sequence
  CXCR4 targeting guide RNA
agacugaccaauauuguacag

SEQ ID NO: 5428 - RNA, 21 nt, Artificial Sequence
  CXCR4 targeting guide RNA
agacuguacacuguaggugcu

SEQ ID NO: 5429 - RNA, 21 nt, Artificial Sequence
  CXCR4 targeting guide RNA
agagcguguagugaaucacgu

SEQ ID NO: 5430 - RNA, 21 nt, Artificial Sequence
  CXCR4 targeting guide RNA
agauaaucucuccauucccgu

SEQ ID NO: 5431 - RNA, 21 nt, Artificial Sequence
  CXCR4 targeting guide RNA
agauggcacuuauaaccaaag

SEQ ID NO: 5432 - RNA, 21 nt, Artificial Sequence
  CXCR4 targeting guide RNA
agcaaaaucacgucuuaagaa

SEQ ID NO: 5433 - RNA, 21 nt, Artificial Sequence
  CXCR4 targeting guide RNA
agcaacuaagaacuuggccac

SEQ ID NO: 5434 - RNA, 21 nt, Artificial Sequence
  CXCR4 targeting guide RNA
agcaccuacaguguacagucu

SEQ ID NO: 5435 - RNA, 21 nt, Artificial Sequence
  CXCR4 targeting guide RNA
agcauuucuauaccacuuugg

SEQ ID NO: 5436 - RNA, 21 nt, Artificial Sequence
  CXCR4 targeting guide RNA
agcccaaagugguauagaaau

SEQ ID NO: 5437 - RNA, 21 nt, Artificial Sequence
  CXCR4 targeting guide RNA
agcguguagugaaucacguaa

SEQ ID NO: 5438 - RNA, 21 nt, Artificial Sequence
  CXCR4 targeting guide RNA
agcuagaaaugauccccagcu

SEQ ID NO: 5439 - RNA, 21 nt, Artificial Sequence
  CXCR4 targeting guide RNA
agcuggggaucauuucuagcu

SEQ ID NO: 5440 - RNA, 21 nt, Artificial Sequence
  CXCR4 targeting guide RNA
agcuuuacgugauucacuaca

SEQ ID NO: 5441 - RNA, 21 nt, Artificial Sequence
  CXCR4 targeting guide RNA
aggaaaaacguuccacgggaa

SEQ ID NO: 5442 - RNA, 21 nt, Artificial Sequence
  CXCR4 targeting guide RNA
aggaccuguggccaaguucuu

SEQ ID NO: 5443 - RNA, 21 nt, Artificial Sequence
  CXCR4 targeting guide RNA
aggacuguagaaaagggaacu

SEQ ID NO: 5444 - RNA, 21 nt, Artificial Sequence
  CXCR4 targeting guide RNA
aggaguggguugauuucagca

SEQ ID NO: 5445 - RNA, 21 nt, Artificial Sequence
  CXCR4 targeting guide RNA
aggcaggaccuguggccaagu

SEQ ID NO: 5446 - RNA, 21 nt, Artificial Sequence
  CXCR4 targeting guide RNA
agggaacugaacauuccagag

SEQ ID NO: 5447 - RNA, 21 nt, Artificial Sequence
  CXCR4 targeting guide RNA
agguccugccuagacacacau

SEQ ID NO: 5448 - RNA, 21 nt, Artificial Sequence
  CXCR4 targeting guide RNA
aggugcugaaaucaacccacu

SEQ ID NO: 5449 - RNA, 21 nt, Artificial Sequence
  CXCR4 targeting guide RNA
aguccuaccacgagacauaca

SEQ ID NO: 5450 - RNA, 21 nt, Artificial Sequence
  CXCR4 targeting guide RNA
agugaaucacguaaagcuaga

SEQ ID NO: 5451 - RNA, 21 nt, Artificial Sequence
  CXCR4 targeting guide RNA
agugccaucuucuacagcaaa

SEQ ID NO: 5452 - RNA, 21 nt, Artificial Sequence
  CXCR4 targeting guide RNA
aguggguugauuucagcaccu

SEQ ID NO: 5453 - RNA, 21 nt, Artificial Sequence
  CXCR4 targeting guide RNA
agugguauagaaaugcugguu

SEQ ID NO: 5454 - RNA, 21 nt, Artificial Sequence
  CXCR4 targeting guide RNA
aguguacagucuuguauuaag

SEQ ID NO: 5455 - RNA, 21 nt, Artificial Sequence
  CXCR4 targeting guide RNA
aguucccuuuucuacaguccu

SEQ ID NO: 5456 - RNA, 21 nt, Artificial Sequence
  CXCR4 targeting guide RNA
aguucuuaguugcuguauguc

SEQ ID NO: 5457 - RNA, 21 nt, Artificial Sequence
  CXCR4 targeting guide RNA
aguugcuguaugucucguggu

SEQ ID NO: 5458 - RNA, 21 nt, Artificial Sequence
  CXCR4 targeting guide RNA
aguuuucaggaguggguugau

SEQ ID NO: 5459 - RNA, 21 nt, Artificial Sequence
  CXCR4 targeting guide RNA
auaaacagcuggggaucauuu

SEQ ID NO: 5460 - RNA, 21 nt, Artificial Sequence
  CXCR4 targeting guide RNA
auaaccaaagcccaaaguggu

SEQ ID NO: 5461 - RNA, 21 nt, Artificial Sequence
  CXCR4 targeting guide RNA
auaagugccaucuucuacagc

SEQ ID NO: 5462 - RNA, 21 nt, Artificial Sequence
  CXCR4 targeting guide RNA
auaaucucuccauucccgugg

SEQ ID NO: 5463 - RNA, 21 nt, Artificial Sequence
  CXCR4 targeting guide RNA
auacaagacuguacacuguag

SEQ ID NO: 5464 - RNA, 21 nt, Artificial Sequence
  CXCR4 targeting guide RNA
auacagcaacuaagaacuugg

SEQ ID NO: 5465 - RNA, 21 nt, Artificial Sequence
  CXCR4 targeting guide RNA
auaccacuuugggcuuugguu

SEQ ID NO: 5466 - RNA, 21 nt, Artificial Sequence
  CXCR4 targeting guide RNA
auagaaaugcugguuuuucag

SEQ ID NO: 5467 - RNA, 21 nt, Artificial Sequence
  CXCR4 targeting guide RNA
auagauaaucucuccauuccc

SEQ ID NO: 5468 - RNA, 21 nt, Artificial Sequence
  CXCR4 targeting guide RNA
auauugaugugugucuaggca

SEQ ID NO: 5469 - RNA, 21 nt, Artificial Sequence
  CXCR4 targeting guide RNA
aucaacccacuccugaaaacu

SEQ ID NO: 5470 - RNA, 21 nt, Artificial Sequence
  CXCR4 targeting guide RNA
aucacguaaagcuagaaauga

SEQ ID NO: 5471 - RNA, 21 nt, Artificial Sequence
  CXCR4 targeting guide RNA
aucacgucuuaagaacaggaa

SEQ ID NO: 5472 - RNA, 21 nt, Artificial Sequence
  CXCR4 targeting guide RNA
aucauuucuagcuuuacguga

SEQ ID NO: 5473 - RNA, 21 nt, Artificial Sequence
  CXCR4 targeting guide RNA
auccccagcuguuuaugcaua

SEQ ID NO: 5474 - RNA, 21 nt, Artificial Sequence
  CXCR4 targeting guide RNA
aucuaugcauaaacagcuggg

SEQ ID NO: 5475 - RNA, 21 nt, Artificial Sequence
  CXCR4 targeting guide RNA
aucucuccauucccguggaac

SEQ ID NO: 5476 - RNA, 21 nt, Artificial Sequence
  CXCR4 targeting guide RNA
aucuucuacagcaaaaucacg

SEQ ID NO: 5477 - RNA, 21 nt, Artificial Sequence
  CXCR4 targeting guide RNA
augauccccagcuguuuaugc

SEQ ID NO: 5478 - RNA, 21 nt, Artificial Sequence
  CXCR4 targeting guide RNA
augcauaaacagcuggggauc

SEQ ID NO: 5479 - RNA, 21 nt, Artificial Sequence
  CXCR4 targeting guide RNA
augcauagauaaucucuccau

SEQ ID NO: 5480 - RNA, 21 nt, Artificial Sequence
  CXCR4 targeting guide RNA
augcugguuuuucaguuuuca

SEQ ID NO: 5481 - RNA, 21 nt, Artificial Sequence
  CXCR4 targeting guide RNA
auggagagauuaucuaugcau

SEQ ID NO: 5482 - RNA, 21 nt, Artificial Sequence
  CXCR4 targeting guide RNA
auggcacuuauaaccaaagcc

SEQ ID NO: 5483 - RNA, 21 nt, Artificial Sequence
  CXCR4 targeting guide RNA
augucucgugguaggacugua

SEQ ID NO: 5484 - RNA, 21 nt, Artificial Sequence
  CXCR4 targeting guide RNA
augugugucuaggcaggaccu

SEQ ID NO: 5485 - RNA, 21 nt, Artificial Sequence
  CXCR4 targeting guide RNA
auguucaguucccuuuucuac

SEQ ID NO: 5486 - RNA, 21 nt, Artificial Sequence
  CXCR4 targeting guide RNA
auucacuacacgcucuggaau

SEQ ID NO: 5487 - RNA, 21 nt, Artificial Sequence
  CXCR4 targeting guide RNA
auuccagagcguguagugaau

SEQ ID NO: 5488 - RNA, 21 nt, Artificial Sequence
  CXCR4 targeting guide RNA
auucccguggaacguuuuucc

SEQ ID NO: 5489 - RNA, 21 nt, Artificial Sequence
  CXCR4 targeting guide RNA
auugaugugugucuaggcagg

SEQ ID NO: 5490 - RNA, 21 nt, Artificial Sequence
  CXCR4 targeting guide RNA
auugcuuguuggauuuuuguc

SEQ ID NO: 5491 - RNA, 21 nt, Artificial Sequence
  CXCR4 targeting guide RNA
auuucagcaccuacaguguac

SEQ ID NO: 5492 - RNA, 21 nt, Artificial Sequence
  CXCR4 targeting guide RNA
auuucuagcuuuacgugauuc

SEQ ID NO: 5493 - RNA, 21 nt, Artificial Sequence
  CXCR4 targeting guide RNA
auuucuauaccacuuugggcu

SEQ ID NO: 5494 - RNA, 21 nt, Artificial Sequence
  CXCR4 targeting guide RNA
auuuugcuguagaagauggca

SEQ ID NO: 5495 - RNA, 21 nt, Artificial Sequence
  CXCR4 targeting guide RNA
caaaaucacgucuuaagaaca

SEQ ID NO: 5496 - RNA, 21 nt, Artificial Sequence
  CXCR4 targeting guide RNA
caaagcccaaagugguauaga

SEQ ID NO: 5497 - RNA, 21 nt, Artificial Sequence
  CXCR4 targeting guide RNA
caaagugguauagaaaugcug

SEQ ID NO: 5498 - RNA, 21 nt, Artificial Sequence
  CXCR4 targeting guide RNA
caacccacuccugaaaacuga

SEQ ID NO: 5499 - RNA, 21 nt, Artificial Sequence
  CXCR4 targeting guide RNA
caacuaagaacuuggccacag

SEQ ID NO: 5500 - RNA, 21 nt, Artificial Sequence
  CXCR4 targeting guide RNA
caacuuaauacaagacuguac

SEQ ID NO: 5501 - RNA, 21 nt, Artificial Sequence
  CXCR4 targeting guide RNA
caagacaaaaauccaacaagc

SEQ ID NO: 5502 - RNA, 21 nt, Artificial Sequence
  CXCR4 targeting guide RNA
caagacuguacacuguaggug

SEQ ID NO: 5503 - RNA, 21 nt, Artificial Sequence
  CXCR4 targeting guide RNA
caaguucuuaguugcuguaug

SEQ ID NO: 5504 - RNA, 21 nt, Artificial Sequence
  CXCR4 targeting guide RNA
cacaagacaaaaauccaacaa

SEQ ID NO: 5505 - RNA, 21 nt, Artificial Sequence
  CXCR4 targeting guide RNA
cacagguccugccuagacaca

SEQ ID NO: 5506 - RNA, 21 nt, Artificial Sequence
  CXCR4 targeting guide RNA
caccuacaguguacagucuug

SEQ ID NO: 5507 - RNA, 21 nt, Artificial Sequence
  CXCR4 targeting guide RNA
cacgagacauacagcaacuaa

SEQ ID NO: 5508 - RNA, 21 nt, Artificial Sequence
  CXCR4 targeting guide RNA
cacgcucuggaauguucaguu

SEQ ID NO: 5509 - RNA, 21 nt, Artificial Sequence
  CXCR4 targeting guide RNA
cacgggaauggagagauuauc

SEQ ID NO: 5510 - RNA, 21 nt, Artificial Sequence
  CXCR4 targeting guide RNA
cacguaaagcuagaaaugauc

SEQ ID NO: 5511 - RNA, 21 nt, Artificial Sequence
  CXCR4 targeting guide RNA
cacgucuuaagaacaggaaaa

SEQ ID NO: 5512 - RNA, 21 nt, Artificial Sequence
  CXCR4 targeting guide RNA
cacuacacgcucuggaauguu

SEQ ID NO: 5513 - RNA, 21 nt, Artificial Sequence
  CXCR4 targeting guide RNA
cacuccugaaaacugaaaaac

SEQ ID NO: 5514 - RNA, 21 nt, Artificial Sequence
  CXCR4 targeting guide RNA
cacuguaggugcugaaaucaa

SEQ ID NO: 5515 - RNA, 21 nt, Artificial Sequence
  CXCR4 targeting guide RNA
cacuuauaaccaaagcccaaa

SEQ ID NO: 5516 - RNA, 21 nt, Artificial Sequence
  CXCR4 targeting guide RNA
cacuuugggcuuugguuauaa

SEQ ID NO: 5517 - RNA, 21 nt, Artificial Sequence
  CXCR4 targeting guide RNA
cagagcguguagugaaucacg

SEQ ID NO: 5518 - RNA, 21 nt, Artificial Sequence
  CXCR4 targeting guide RNA
cagauauaaaagacugaccaa

SEQ ID NO: 5519 - RNA, 21 nt, Artificial Sequence
  CXCR4 targeting guide RNA
cagcaaaaucacgucuuaaga

SEQ ID NO: 5520 - RNA, 21 nt, Artificial Sequence
  CXCR4 targeting guide RNA
cagcaacuaagaacuuggcca

SEQ ID NO: 5521 - RNA, 21 nt, Artificial Sequence
  CXCR4 targeting guide RNA
cagcaccuacaguguacaguc

SEQ ID NO: 5522 - RNA, 21 nt, Artificial Sequence
  CXCR4 targeting guide RNA
cagcauuucuauaccacuuug

SEQ ID NO: 5523 - RNA, 21 nt, Artificial Sequence
  CXCR4 targeting guide RNA
cagcuggggaucauuucuagc

SEQ ID NO: 5524 - RNA, 21 nt, Artificial Sequence
  CXCR4 targeting guide RNA
cagcuguuuaugcauagauaa

SEQ ID NO: 5525 - RNA, 21 nt, Artificial Sequence
  CXCR4 targeting guide RNA
caggaaaaacguuccacggga

SEQ ID NO: 5526 - RNA, 21 nt, Artificial Sequence
  CXCR4 targeting guide RNA
caggaccuguggccaaguucu

SEQ ID NO: 5527 - RNA, 21 nt, Artificial Sequence
  CXCR4 targeting guide RNA
caggaguggguugauuucagc

SEQ ID NO: 5528 - RNA, 21 nt, Artificial Sequence
  CXCR4 targeting guide RNA
cagguccugccuagacacaca

SEQ ID NO: 5529 - RNA, 21 nt, Artificial Sequence
  CXCR4 targeting guide RNA
caguccuaccacgagacauac

SEQ ID NO: 5530 - RNA, 21 nt, Artificial Sequence
  CXCR4 targeting guide RNA
caguguacagucuuguauuaa

SEQ ID NO: 5531 - RNA, 21 nt, Artificial Sequence
  CXCR4 targeting guide RNA
caguucccuuuucuacagucc

SEQ ID NO: 5532 - RNA, 21 nt, Artificial Sequence
  CXCR4 targeting guide RNA
caguuuucaggaguggguuga

SEQ ID NO: 5533 - RNA, 21 nt, Artificial Sequence
  CXCR4 targeting guide RNA
caguuuuuauugcuuguugga

SEQ ID NO: 5534 - RNA, 21 nt, Artificial Sequence
  CXCR4 targeting guide RNA
cauaaacagcuggggaucauu

SEQ ID NO: 5535 - RNA, 21 nt, Artificial Sequence
  CXCR4 targeting guide RNA
cauacagcaacuaagaacuug

SEQ ID NO: 5536 - RNA, 21 nt, Artificial Sequence
  CXCR4 targeting guide RNA
cauagauaaucucuccauucc

SEQ ID NO: 5537 - RNA, 21 nt, Artificial Sequence
  CXCR4 targeting guide RNA
cauauugaugugugucuaggc

SEQ ID NO: 5538 - RNA, 21 nt, Artificial Sequence
  CXCR4 targeting guide RNA
caucuucuacagcaaaaucac

SEQ ID NO: 5539 - RNA, 21 nt, Artificial Sequence
  CXCR4 targeting guide RNA
cauuccagagcguguagugaa

SEQ ID NO: 5540 - RNA, 21 nt, Artificial Sequence
  CXCR4 targeting guide RNA
cauucccguggaacguuuuuc

SEQ ID NO: 5541 - RNA, 21 nt, Artificial Sequence
  CXCR4 targeting guide RNA
cauuucuagcuuuacgugauu

SEQ ID NO: 5542 - RNA, 21 nt, Artificial Sequence
  CXCR4 targeting guide RNA
cauuucuauaccacuuugggc

SEQ ID NO: 5543 - RNA, 21 nt, Artificial Sequence
  CXCR4 targeting guide RNA
ccaaagcccaaagugguauag

SEQ ID NO: 5544 - RNA, 21 nt, Artificial Sequence
  CXCR4 targeting guide RNA
ccaaagugguauagaaaugcu

SEQ ID NO: 5545 - RNA, 21 nt, Artificial Sequence
  CXCR4 targeting guide RNA
ccaacaagcaauaaaaacugu

SEQ ID NO: 5546 - RNA, 21 nt, Artificial Sequence
  CXCR4 targeting guide RNA
ccaaguucuuaguugcuguau

SEQ ID NO: 5547 - RNA, 21 nt, Artificial Sequence
  CXCR4 targeting guide RNA
ccacagguccugccuagacac

SEQ ID NO: 5548 - RNA, 21 nt, Artificial Sequence
  CXCR4 targeting guide RNA
ccacgagacauacagcaacua

SEQ ID NO: 5549 - RNA, 21 nt, Artificial Sequence
  CXCR4 targeting guide RNA
ccacgggaauggagagauuau

SEQ ID NO: 5550 - RNA, 21 nt, Artificial Sequence
  CXCR4 targeting guide RNA
ccacuccugaaaacugaaaaa

SEQ ID NO: 5551 - RNA, 21 nt, Artificial Sequence
  CXCR4 targeting guide RNA
ccacuuugggcuuugguuaua

SEQ ID NO: 5552 - RNA, 21 nt, Artificial Sequence
  CXCR4 targeting guide RNA
ccagagcguguagugaaucac

SEQ ID NO: 5553 - RNA, 21 nt, Artificial Sequence
  CXCR4 targeting guide RNA
ccagcauuucuauaccacuuu

SEQ ID NO: 5554 - RNA, 21 nt, Artificial Sequence
  CXCR4 targeting guide RNA
ccagcuguuuaugcauagaua

SEQ ID NO: 5555 - RNA, 21 nt, Artificial Sequence
  CXCR4 targeting guide RNA
ccaucuucuacagcaaaauca

SEQ ID NO: 5556 - RNA, 21 nt, Artificial Sequence
  CXCR4 targeting guide RNA
ccauucccguggaacguuuuu

SEQ ID NO: 5557 - RNA, 21 nt, Artificial Sequence
  CXCR4 targeting guide RNA
cccaaagugguauagaaaugc

SEQ ID NO: 5558 - RNA, 21 nt, Artificial Sequence
  CXCR4 targeting guide RNA
cccacuccugaaaacugaaaa

SEQ ID NO: 5559 - RNA, 21 nt, Artificial Sequence
  CXCR4 targeting guide RNA
cccagcuguuuaugcauagau

SEQ ID NO: 5560 - RNA, 21 nt, Artificial Sequence
  CXCR4 targeting guide RNA
ccccagcuguuuaugcauaga

SEQ ID NO: 5561 - RNA, 21 nt, Artificial Sequence
  CXCR4 targeting guide RNA
cccguggaacguuuuuccugu

SEQ ID NO: 5562 - RNA, 21 nt, Artificial Sequence
  CXCR4 targeting guide RNA
cccuuuucuacaguccuacca

SEQ ID NO: 5563 - RNA, 21 nt, Artificial Sequence
  CXCR4 targeting guide RNA
ccguggaacguuuuuccuguu

SEQ ID NO: 5564 - RNA, 21 nt, Artificial Sequence
  CXCR4 targeting guide RNA
ccuacaguguacagucuugua

SEQ ID NO: 5565 - RNA, 21 nt, Artificial Sequence
  CXCR4 targeting guide RNA
ccuaccacgagacauacagca

SEQ ID NO: 5566 - RNA, 21 nt, Artificial Sequence
  CXCR4 targeting guide RNA
ccuagacacacaucaauauga

SEQ ID NO: 5567 - RNA, 21 nt, Artificial Sequence
  CXCR4 targeting guide RNA
ccugaaaacugaaaaaccagc

SEQ ID NO: 5568 - RNA, 21 nt, Artificial Sequence
  CXCR4 targeting guide RNA
ccugccuagacacacaucaau

SEQ ID NO: 5569 - RNA, 21 nt, Artificial Sequence
  CXCR4 targeting guide RNA
ccuguggccaaguucuuaguu

SEQ ID NO: 5570 - RNA, 21 nt, Artificial Sequence
  CXCR4 targeting guide RNA
ccuguucuuaagacgugauuu

SEQ ID NO: 5571 - RNA, 21 nt, Artificial Sequence
  CXCR4 targeting guide RNA
ccuuuucuacaguccuaccac

SEQ ID NO: 5572 - RNA, 21 nt, Artificial Sequence
  CXCR4 targeting guide RNA
cgagacauacagcaacuaaga

SEQ ID NO: 5573 - RNA, 21 nt, Artificial Sequence
  CXCR4 targeting guide RNA
cgcucuggaauguucaguucc

SEQ ID NO: 5574 - RNA, 21 nt, Artificial Sequence
  CXCR4 targeting guide RNA
cgggaauggagagauuaucua

SEQ ID NO: 5575 - RNA, 21 nt, Artificial Sequence
  CXCR4 targeting guide RNA
cguaaagcuagaaaugauccc

SEQ ID NO: 5576 - RNA, 21 nt, Artificial Sequence
  CXCR4 targeting guide RNA
cgucuuaagaacaggaaaaac

SEQ ID NO: 5577 - RNA, 21 nt, Artificial Sequence
  CXCR4 targeting guide RNA
cgugauucacuacacgcucug

SEQ ID NO: 5578 - RNA, 21 nt, Artificial Sequence
  CXCR4 targeting guide RNA
cgugauuuugcuguagaagau

SEQ ID NO: 5579 - RNA, 21 nt, Artificial Sequence
  CXCR4 targeting guide RNA
cguggaacguuuuuccuguuc

SEQ ID NO: 5580 - RNA, 21 nt, Artificial Sequence
  CXCR4 targeting guide RNA
cgugguaggacuguagaaaag

SEQ ID NO: 5581 - RNA, 21 nt, Artificial Sequence
  CXCR4 targeting guide RNA
cguguagugaaucacguaaag

SEQ ID NO: 5582 - RNA, 21 nt, Artificial Sequence
  CXCR4 targeting guide RNA
cguuccacgggaauggagaga

SEQ ID NO: 5583 - RNA, 21 nt, Artificial Sequence
  CXCR4 targeting guide RNA
cguuuuuccuguucuuaagac

SEQ ID NO: 5584 - RNA, 21 nt, Artificial Sequence
  CXCR4 targeting guide RNA
cuaagaacuuggccacagguc

SEQ ID NO: 5585 - RNA, 21 nt, Artificial Sequence
  CXCR4 targeting guide RNA
cuacacgcucuggaauguuca

SEQ ID NO: 5586 - RNA, 21 nt, Artificial Sequence
  CXCR4 targeting guide RNA
cuacagcaaaaucacgucuua

SEQ ID NO: 5587 - RNA, 21 nt, Artificial Sequence
  CXCR4 targeting guide RNA
cuacaguccuaccacgagaca

SEQ ID NO: 5588 - RNA, 21 nt, Artificial Sequence
  CXCR4 targeting guide RNA
cuacaguguacagucuuguau

SEQ ID NO: 5589 - RNA, 21 nt, Artificial Sequence
  CXCR4 targeting guide RNA
cuaccacgagacauacagcaa

SEQ ID NO: 5590 - RNA, 21 nt, Artificial Sequence
  CXCR4 targeting guide RNA
cuagaaaugauccccagcugu

SEQ ID NO: 5591 - RNA, 21 nt, Artificial Sequence
  CXCR4 targeting guide RNA
cuagacacacaucaauaugaa

SEQ ID NO: 5592 - RNA, 21 nt, Artificial Sequence
  CXCR4 targeting guide RNA
cuagcuuuacgugauucacua

SEQ ID NO: 5593 - RNA, 21 nt, Artificial Sequence
  CXCR4 targeting guide RNA
cuaggcaggaccuguggccaa

SEQ ID NO: 5594 - RNA, 21 nt, Artificial Sequence
  CXCR4 targeting guide RNA
cuauaccacuuugggcuuugg

SEQ ID NO: 5595 - RNA, 21 nt, Artificial Sequence
  CXCR4 targeting guide RNA
cuaugcauaaacagcugggga

SEQ ID NO: 5596 - RNA, 21 nt, Artificial Sequence
  CXCR4 targeting guide RNA
cuccauucccguggaacguuu

SEQ ID NO: 5597 - RNA, 21 nt, Artificial Sequence
  CXCR4 targeting guide RNA
cuccugaaaacugaaaaacca

SEQ ID NO: 5598 - RNA, 21 nt, Artificial Sequence
  CXCR4 targeting guide RNA
cucgugguaggacuguagaaa

SEQ ID NO: 5599 - RNA, 21 nt, Artificial Sequence
  CXCR4 targeting guide RNA
cucuccauucccguggaacgu

SEQ ID NO: 5600 - RNA, 21 nt, Artificial Sequence
  CXCR4 targeting guide RNA
cucuggaauguucaguucccu

SEQ ID NO: 5601 - RNA, 21 nt, Artificial Sequence
  CXCR4 targeting guide RNA
cugaaaaaccagcauuucuau

SEQ ID NO: 5602 - RNA, 21 nt, Artificial Sequence
  CXCR4 targeting guide RNA
cugaaaacugaaaaaccagca

SEQ ID NO: 5603 - RNA, 21 nt, Artificial Sequence
  CXCR4 targeting guide RNA
cugaaaucaacccacuccuga

SEQ ID NO: 5604 - RNA, 21 nt, Artificial Sequence
  CXCR4 targeting guide RNA
cugaacauuccagagcgugua

SEQ ID NO: 5605 - RNA, 21 nt, Artificial Sequence
  CXCR4 targeting guide RNA
cugaccaauauuguacaguuu

SEQ ID NO: 5606 - RNA, 21 nt, Artificial Sequence
  CXCR4 targeting guide RNA
cugccuagacacacaucaaua

SEQ ID NO: 5607 - RNA, 21 nt, Artificial Sequence
  CXCR4 targeting guide RNA
cuggaauguucaguucccuuu

SEQ ID NO: 5608 - RNA, 21 nt, Artificial Sequence
  CXCR4 targeting guide RNA
cuggggaucauuucuagcuuu

SEQ ID NO: 5609 - RNA, 21 nt, Artificial Sequence
  CXCR4 targeting guide RNA
cugguuuuucaguuuucagga

SEQ ID NO: 5610 - RNA, 21 nt, Artificial Sequence
  CXCR4 targeting guide RNA
cuguacaauauuggucagucu

SEQ ID NO: 5611 - RNA, 21 nt, Artificial Sequence
  CXCR4 targeting guide RNA
cuguacacuguaggugcugaa

SEQ ID NO: 5612 - RNA, 21 nt, Artificial Sequence
  CXCR4 targeting guide RNA
cuguagaaaagggaacugaac

SEQ ID NO: 5613 - RNA, 21 nt, Artificial Sequence
  CXCR4 targeting guide RNA
cuguagaagauggcacuuaua

SEQ ID NO: 5614 - RNA, 21 nt, Artificial Sequence
  CXCR4 targeting guide RNA
cuguaggugcugaaaucaacc

SEQ ID NO: 5615 - RNA, 21 nt, Artificial Sequence
  CXCR4 targeting guide RNA
cuguaugucucgugguaggac

SEQ ID NO: 5616 - RNA, 21 nt, Artificial Sequence
  CXCR4 targeting guide RNA
cuguggccaaguucuuaguug

SEQ ID NO: 5617 - RNA, 21 nt, Artificial Sequence
  CXCR4 targeting guide RNA
cuguucuuaagacgugauuuu

SEQ ID NO: 5618 - RNA, 21 nt, Artificial Sequence
  CXCR4 targeting guide RNA
cuuaagaacaggaaaaacguu

SEQ ID NO: 5619 - RNA, 21 nt, Artificial Sequence
  CXCR4 targeting guide RNA
cuuaagacgugauuuugcugu

SEQ ID NO: 5620 - RNA, 21 nt, Artificial Sequence
  CXCR4 targeting guide RNA
cuuaauacaagacuguacacu

SEQ ID NO: 5621 - RNA, 21 nt, Artificial Sequence
  CXCR4 targeting guide RNA
cuuaguugcuguaugucucgu

SEQ ID NO: 5622 - RNA, 21 nt, Artificial Sequence
  CXCR4 targeting guide RNA
cuuauaaccaaagcccaaagu

SEQ ID NO: 5623 - RNA, 21 nt, Artificial Sequence
  CXCR4 targeting guide RNA
cuucuacagcaaaaucacguc

SEQ ID NO: 5624 - RNA, 21 nt, Artificial Sequence
  CXCR4 targeting guide RNA
cuuggccacagguccugccua

SEQ ID NO: 5625 - RNA, 21 nt, Artificial Sequence
  CXCR4 targeting guide RNA
cuuguuggauuuuugucuugu

SEQ ID NO: 5626 - RNA, 21 nt, Artificial Sequence
  CXCR4 targeting guide RNA
cuuuacgugauucacuacacg

SEQ ID NO: 5627 - RNA, 21 nt, Artificial Sequence
  CXCR4 targeting guide RNA
cuuugggcuuugguuauaagu

SEQ ID NO: 5628 - RNA, 21 nt, Artificial Sequence
  CXCR4 targeting guide RNA
cuuugguuauaagugccaucu

SEQ ID NO: 5629 - RNA, 21 nt, Artificial Sequence
  CXCR4 targeting guide RNA
cuuuucuacaguccuaccacg

SEQ ID NO: 5630 - RNA, 21 nt, Artificial Sequence
  CXCR4 targeting guide RNA
gaaaaaccagcauuucuauac

SEQ ID NO: 5631 - RNA, 21 nt, Artificial Sequence
  CXCR4 targeting guide RNA
gaaaaacguuccacgggaaug

SEQ ID NO: 5632 - RNA, 21 nt, Artificial Sequence
  CXCR4 targeting guide RNA
gaaaacugaaaaaccagcauu

SEQ ID NO: 5633 - RNA, 21 nt, Artificial Sequence
  CXCR4 targeting guide RNA
gaaaagggaacugaacauucc

SEQ ID NO: 5634 - RNA, 21 nt, Artificial Sequence
  CXCR4 targeting guide RNA
gaaacacaagacaaaaaucca

SEQ ID NO: 5635 - RNA, 21 nt, Artificial Sequence
  CXCR4 targeting guide RNA
gaaaucaacccacuccugaaa

SEQ ID NO: 5636 - RNA, 21 nt, Artificial Sequence
  CXCR4 targeting guide RNA
gaaaugauccccagcuguuua

SEQ ID NO: 5637 - RNA, 21 nt, Artificial Sequence
  CXCR4 targeting guide RNA
gaaaugcugguuuuucaguuu

SEQ ID NO: 5638 - RNA, 21 nt, Artificial Sequence
  CXCR4 targeting guide RNA
gaacaggaaaaacguuccacg

SEQ ID NO: 5639 - RNA, 21 nt, Artificial Sequence
  CXCR4 targeting guide RNA
gaacauuccagagcguguagu

SEQ ID NO: 5640 - RNA, 21 nt, Artificial Sequence
  CXCR4 targeting guide RNA
gaacguuuuuccuguucuuaa

SEQ ID NO: 5641 - RNA, 21 nt, Artificial Sequence
  CXCR4 targeting guide RNA
gaacugaacauuccagagcgu

SEQ ID NO: 5642 - RNA, 21 nt, Artificial Sequence
  CXCR4 targeting guide RNA
gaacuuggccacagguccugc

SEQ ID NO: 5643 - RNA, 21 nt, Artificial Sequence
  CXCR4 targeting guide RNA
gaagauggcacuuauaaccaa

SEQ ID NO: 5644 - RNA, 21 nt, Artificial Sequence
  CXCR4 targeting guide RNA
gaaucacguaaagcuagaaau

SEQ ID NO: 5645 - RNA, 21 nt, Artificial Sequence
  CXCR4 targeting guide RNA
gaauggagagauuaucuaugc

SEQ ID NO: 5646 - RNA, 21 nt, Artificial Sequence
  CXCR4 targeting guide RNA
gaauguucaguucccuuuucu

SEQ ID NO: 5647 - RNA, 21 nt, Artificial Sequence
  CXCR4 targeting guide RNA
gacaaaaauccaacaagcaau

SEQ ID NO: 5648 - RNA, 21 nt, Artificial Sequence
  CXCR4 targeting guide RNA
gacacacaucaauaugaaaca

SEQ ID NO: 5649 - RNA, 21 nt, Artificial Sequence
  CXCR4 targeting guide RNA
gacauacagcaacuaagaacu

SEQ ID NO: 5650 - RNA, 21 nt, Artificial Sequence
  CXCR4 targeting guide RNA
gaccuguggccaaguucuuag

SEQ ID NO: 5651 - RNA, 21 nt, Artificial Sequence
  CXCR4 targeting guide RNA
gacgugauuuugcuguagaag

SEQ ID NO: 5652 - RNA, 21 nt, Artificial Sequence
  CXCR4 targeting guide RNA
gacugaccaauauuguacagu

SEQ ID NO: 5653 - RNA, 21 nt, Artificial Sequence
  CXCR4 targeting guide RNA
gacuguacacuguaggugcug

SEQ ID NO: 5654 - RNA, 21 nt, Artificial Sequence
  CXCR4 targeting guide RNA
gacuguagaaaagggaacuga

SEQ ID NO: 5655 - RNA, 21 nt, Artificial Sequence
  CXCR4 targeting guide RNA
gagacauacagcaacuaagaa

SEQ ID NO: 5656 - RNA, 21 nt, Artificial Sequence
  CXCR4 targeting guide RNA
gagcguguagugaaucacgua

SEQ ID NO: 5657 - RNA, 21 nt, Artificial Sequence
  CXCR4 targeting guide RNA
gaguggguugauuucagcacc

SEQ ID NO: 5658 - RNA, 21 nt, Artificial Sequence
  CXCR4 targeting guide RNA
gauaaucucuccauucccgug

SEQ ID NO: 5659 - RNA, 21 nt, Artificial Sequence
  CXCR4 targeting guide RNA
gaucauuucuagcuuuacgug

SEQ ID NO: 5660 - RNA, 21 nt, Artificial Sequence
  CXCR4 targeting guide RNA
gauccccagcuguuuaugcau

SEQ ID NO: 5661 - RNA, 21 nt, Artificial Sequence
  CXCR4 targeting guide RNA
gauggcacuuauaaccaaagc

SEQ ID NO: 5662 - RNA, 21 nt, Artificial Sequence
  CXCR4 targeting guide RNA
gaugugugucuaggcaggacc

SEQ ID NO: 5663 - RNA, 21 nt, Artificial Sequence
  CXCR4 targeting guide RNA
gauuaucuaugcauaaacagc

SEQ ID NO: 5664 - RNA, 21 nt, Artificial Sequence
  CXCR4 targeting guide RNA
gauucacuacacgcucuggaa

SEQ ID NO: 5665 - RNA, 21 nt, Artificial Sequence
  CXCR4 targeting guide RNA
gauuucagcaccuacagugua

SEQ ID NO: 5666 - RNA, 21 nt, Artificial Sequence
  CXCR4 targeting guide RNA
gauuuugcuguagaagauggc

SEQ ID NO: 5667 - RNA, 21 nt, Artificial Sequence
  CXCR4 targeting guide RNA
gcaaaaucacgucuuaagaac

SEQ ID NO: 5668 - RNA, 21 nt, Artificial Sequence
  CXCR4 targeting guide RNA
gcaacuaagaacuuggccaca

SEQ ID NO: 5669 - RNA, 21 nt, Artificial Sequence
  CXCR4 targeting guide RNA
gcaccuacaguguacagucuu

SEQ ID NO: 5670 - RNA, 21 nt, Artificial Sequence
  CXCR4 targeting guide RNA
gcacuuauaaccaaagcccaa

SEQ ID NO: 5671 - RNA, 21 nt, Artificial Sequence
  CXCR4 targeting guide RNA
gcaggaccuguggccaaguuc

SEQ ID NO: 5672 - RNA, 21 nt, Artificial Sequence
  CXCR4 targeting guide RNA
gcauaaacagcuggggaucau

SEQ ID NO: 5673 - RNA, 21 nt, Artificial Sequence
  CXCR4 targeting guide RNA
gcauagauaaucucuccauuc

SEQ ID NO: 5674 - RNA, 21 nt, Artificial Sequence
  CXCR4 targeting guide RNA
gcauuucuauaccacuuuggg

SEQ ID NO: 5675 - RNA, 21 nt, Artificial Sequence
  CXCR4 targeting guide RNA
gccaaguucuuaguugcugua

SEQ ID NO: 5676 - RNA, 21 nt, Artificial Sequence
  CXCR4 targeting guide RNA
gccacagguccugccuagaca

SEQ ID NO: 5677 - RNA, 21 nt, Artificial Sequence
  CXCR4 targeting guide RNA
gccaucuucuacagcaaaauc

SEQ ID NO: 5678 - RNA, 21 nt, Artificial Sequence
  CXCR4 targeting guide RNA
gcccaaagugguauagaaaug

SEQ ID NO: 5679 - RNA, 21 nt, Artificial Sequence
  CXCR4 targeting guide RNA
gccuagacacacaucaauaug

SEQ ID NO: 5680 - RNA, 21 nt, Artificial Sequence
  CXCR4 targeting guide RNA
gcguguagugaaucacguaaa

SEQ ID NO: 5681 - RNA, 21 nt, Artificial Sequence
  CXCR4 targeting guide RNA
gcuagaaaugauccccagcug

SEQ ID NO: 5682 - RNA, 21 nt, Artificial Sequence
  CXCR4 targeting guide RNA
gcucuggaauguucaguuccc

SEQ ID NO: 5683 - RNA, 21 nt, Artificial Sequence
  CXCR4 targeting guide RNA
gcugaaaucaacccacuccug

SEQ ID NO: 5684 - RNA, 21 nt, Artificial Sequence
  CXCR4 targeting guide RNA
gcuggggaucauuucuagcuu

SEQ ID NO: 5685 - RNA, 21 nt, Artificial Sequence
  CXCR4 targeting guide RNA
gcugguuuuucaguuuucagg

SEQ ID NO: 5686 - RNA, 21 nt, Artificial Sequence
  CXCR4 targeting guide RNA
gcuguagaagauggcacuuau

SEQ ID NO: 5687 - RNA, 21 nt, Artificial Sequence
  CXCR4 targeting guide RNA
gcuguaugucucgugguagga

SEQ ID NO: 5688 - RNA, 21 nt, Artificial Sequence
  CXCR4 targeting guide RNA
gcuguuuaugcauagauaauc

SEQ ID NO: 5689 - RNA, 21 nt, Artificial Sequence
  CXCR4 targeting guide RNA
gcuuguuggauuuuugucuug

SEQ ID NO: 5690 - RNA, 21 nt, Artificial Sequence
  CXCR4 targeting guide RNA
gcuuuacgugauucacuacac

SEQ ID NO: 5691 - RNA, 21 nt, Artificial Sequence
  CXCR4 targeting guide RNA
gcuuugguuauaagugccauc

SEQ ID NO: 5692 - RNA, 21 nt, Artificial Sequence
  CXCR4 targeting guide RNA
ggaaaaacguuccacgggaau

SEQ ID NO: 5693 - RNA, 21 nt, Artificial Sequence
  CXCR4 targeting guide RNA
ggaacguuuuuccuguucuua

SEQ ID NO: 5694 - RNA, 21 nt, Artificial Sequence
  CXCR4 targeting guide RNA
ggaacugaacauuccagagcg

SEQ ID NO: 5695 - RNA, 21 nt, Artificial Sequence
  CXCR4 targeting guide RNA
ggaauggagagauuaucuaug

SEQ ID NO: 5696 - RNA, 21 nt, Artificial Sequence
  CXCR4 targeting guide RNA
ggaauguucaguucccuuuuc

SEQ ID NO: 5697 - RNA, 21 nt, Artificial Sequence
  CXCR4 targeting guide RNA
ggaccuguggccaaguucuua

SEQ ID NO: 5698 - RNA, 21 nt, Artificial Sequence
  CXCR4 targeting guide RNA
ggacuguagaaaagggaacug

SEQ ID NO: 5699 - RNA, 21 nt, Artificial Sequence
  CXCR4 targeting guide RNA
ggagagauuaucuaugcauaa

SEQ ID NO: 5700 - RNA, 21 nt, Artificial Sequence
  CXCR4 targeting guide RNA
ggaguggguugauuucagcac

SEQ ID NO: 5701 - RNA, 21 nt, Artificial Sequence
  CXCR4 targeting guide RNA
ggaucauuucuagcuuuacgu

SEQ ID NO: 5702 - RNA, 21 nt, Artificial Sequence
  CXCR4 targeting guide RNA
ggauuuuugucuuguguuucu

SEQ ID NO: 5703 - RNA, 21 nt, Artificial Sequence
  CXCR4 targeting guide RNA
ggcacuuauaaccaaagccca

SEQ ID NO: 5704 - RNA, 21 nt, Artificial Sequence
  CXCR4 targeting guide RNA
ggcaggaccuguggccaaguu

SEQ ID NO: 5705 - RNA, 21 nt, Artificial Sequence
  CXCR4 targeting guide RNA
ggccaaguucuuaguugcugu

SEQ ID NO: 5706 - RNA, 21 nt, Artificial Sequence
  CXCR4 targeting guide RNA
ggccacagguccugccuagac

SEQ ID NO: 5707 - RNA, 21 nt, Artificial Sequence
  CXCR4 targeting guide RNA
ggcuuugguuauaagugccau

SEQ ID NO: 5708 - RNA, 21 nt, Artificial Sequence
  CXCR4 targeting guide RNA
gggaacugaacauuccagagc

SEQ ID NO: 5709 - RNA, 21 nt, Artificial Sequence
  CXCR4 targeting guide RNA
gggaauggagagauuaucuau

SEQ ID NO: 5710 - RNA, 21 nt, Artificial Sequence
  CXCR4 targeting guide RNA
gggaucauuucuagcuuuacg

SEQ ID NO: 5711 - RNA, 21 nt, Artificial Sequence
  CXCR4 targeting guide RNA
gggcuuugguuauaagugcca

SEQ ID NO: 5712 - RNA, 21 nt, Artificial Sequence
  CXCR4 targeting guide RNA
ggggaucauuucuagcuuuac

SEQ ID NO: 5713 - RNA, 21 nt, Artificial Sequence
  CXCR4 targeting guide RNA
ggguugauuucagcaccuaca

SEQ ID NO: 5714 - RNA, 21 nt, Artificial Sequence
  CXCR4 targeting guide RNA
gguaggacuguagaaaaggga

SEQ ID NO: 5715 - RNA, 21 nt, Artificial Sequence
  CXCR4 targeting guide RNA
gguauagaaaugcugguuuuu

SEQ ID NO: 5716 - RNA, 21 nt, Artificial Sequence
  CXCR4 targeting guide RNA
ggucagucuuuuauaucugaa

SEQ ID NO: 5717 - RNA, 21 nt, Artificial Sequence
  CXCR4 targeting guide RNA
gguccugccuagacacacauc

SEQ ID NO: 5718 - RNA, 21 nt, Artificial Sequence
  CXCR4 targeting guide RNA
ggugcugaaaucaacccacuc

SEQ ID NO: 5719 - RNA, 21 nt, Artificial Sequence
  CXCR4 targeting guide RNA
gguuauaagugccaucuucua

SEQ ID NO: 5720 - RNA, 21 nt, Artificial Sequence
  CXCR4 targeting guide RNA
gguugauuucagcaccuacag

SEQ ID NO: 5721 - RNA, 21 nt, Artificial Sequence
  CXCR4 targeting guide RNA
gguuuuucaguuuucaggagu

SEQ ID NO: 5722 - RNA, 21 nt, Artificial Sequence
  CXCR4 targeting guide RNA
guaaagcuagaaaugaucccc

SEQ ID NO: 5723 - RNA, 21 nt, Artificial Sequence
  CXCR4 targeting guide RNA
guacaauauuggucagucuuu

SEQ ID NO: 5724 - RNA, 21 nt, Artificial Sequence
  CXCR4 targeting guide RNA
guacacuguaggugcugaaau

SEQ ID NO: 5725 - RNA, 21 nt, Artificial Sequence
  CXCR4 targeting guide RNA
guacagucuuguauuaaguug

SEQ ID NO: 5726 - RNA, 21 nt, Artificial Sequence
  CXCR4 targeting guide RNA
guagaaaagggaacugaacau

SEQ ID NO: 5727 - RNA, 21 nt, Artificial Sequence
  CXCR4 targeting guide RNA
guagaagauggcacuuauaac

SEQ ID NO: 5728 - RNA, 21 nt, Artificial Sequence
  CXCR4 targeting guide RNA
guaggacuguagaaaagggaa

SEQ ID NO: 5729 - RNA, 21 nt, Artificial Sequence
  CXCR4 targeting guide RNA
guaggugcugaaaucaaccca

SEQ ID NO: 5730 - RNA, 21 nt, Artificial Sequence
  CXCR4 targeting guide RNA
guagugaaucacguaaagcua

SEQ ID NO: 5731 - RNA, 21 nt, Artificial Sequence
  CXCR4 targeting guide RNA
guauagaaaugcugguuuuuc

SEQ ID NO: 5732 - RNA, 21 nt, Artificial Sequence
  CXCR4 targeting guide RNA
guaugucucgugguaggacug

SEQ ID NO: 5733 - RNA, 21 nt, Artificial Sequence
  CXCR4 targeting guide RNA
guccuaccacgagacauacag

SEQ ID NO: 5734 - RNA, 21 nt, Artificial Sequence
  CXCR4 targeting guide RNA
guccugccuagacacacauca

SEQ ID NO: 5735 - RNA, 21 nt, Artificial Sequence
  CXCR4 targeting guide RNA
gucuaggcaggaccuguggcc

SEQ ID NO: 5736 - RNA, 21 nt, Artificial Sequence
  CXCR4 targeting guide RNA
gucucgugguaggacuguaga

SEQ ID NO: 5737 - RNA, 21 nt, Artificial Sequence
  CXCR4 targeting guide RNA
gucuuaagaacaggaaaaacg

SEQ ID NO: 5738 - RNA, 21 nt, Artificial Sequence
  CXCR4 targeting guide RNA
gugaaucacguaaagcuagaa

SEQ ID NO: 5739 - RNA, 21 nt, Artificial Sequence
  CXCR4 targeting guide RNA
gugauucacuacacgcucugg

SEQ ID NO: 5740 - RNA, 21 nt, Artificial Sequence
  CXCR4 targeting guide RNA
gugauuuugcuguagaagaug

SEQ ID NO: 5741 - RNA, 21 nt, Artificial Sequence
  CXCR4 targeting guide RNA
gugccaucuucuacagcaaaa

SEQ ID NO: 5742 - RNA, 21 nt, Artificial Sequence
  CXCR4 targeting guide RNA
gugcugaaaucaacccacucc

SEQ ID NO: 5743 - RNA, 21 nt, Artificial Sequence
  CXCR4 targeting guide RNA
guggaacguuuuuccuguucu

SEQ ID NO: 5744 - RNA, 21 nt, Artificial Sequence
  CXCR4 targeting guide RNA
guggccaaguucuuaguugcu

SEQ ID NO: 5745 - RNA, 21 nt, Artificial Sequence
  CXCR4 targeting guide RNA
guggguugauuucagcaccua

SEQ ID NO: 5746 - RNA, 21 nt, Artificial Sequence
  CXCR4 targeting guide RNA
gugguaggacuguagaaaagg

SEQ ID NO: 5747 - RNA, 21 nt, Artificial Sequence
  CXCR4 targeting guide RNA
gugguauagaaaugcugguuu

SEQ ID NO: 5748 - RNA, 21 nt, Artificial Sequence
  CXCR4 targeting guide RNA
guguacagucuuguauuaagu

SEQ ID NO: 5749 - RNA, 21 nt, Artificial Sequence
  CXCR4 targeting guide RNA
guguagugaaucacguaaagc

SEQ ID NO: 5750 - RNA, 21 nt, Artificial Sequence
  CXCR4 targeting guide RNA
gugucuaggcaggaccugugg

SEQ ID NO: 5751 - RNA, 21 nt, Artificial Sequence
  CXCR4 targeting guide RNA
gugugucuaggcaggaccugu

SEQ ID NO: 5752 - RNA, 21 nt, Artificial Sequence
  CXCR4 targeting guide RNA
guuauaagugccaucuucuac

SEQ ID NO: 5753 - RNA, 21 nt, Artificial Sequence
  CXCR4 targeting guide RNA
guucaguucccuuuucuacag

SEQ ID NO: 5754 - RNA, 21 nt, Artificial Sequence
  CXCR4 targeting guide RNA
guuccacgggaauggagagau

SEQ ID NO: 5755 - RNA, 21 nt, Artificial Sequence
  CXCR4 targeting guide RNA
guucccuuuucuacaguccua

SEQ ID NO: 5756 - RNA, 21 nt, Artificial Sequence
  CXCR4 targeting guide RNA
guucuuaagacgugauuuugc

SEQ ID NO: 5757 - RNA, 21 nt, Artificial Sequence
  CXCR4 targeting guide RNA
guucuuaguugcuguaugucu

SEQ ID NO: 5758 - RNA, 21 nt, Artificial Sequence
  CXCR4 targeting guide RNA
guugauuucagcaccuacagu

SEQ ID NO: 5759 - RNA, 21 nt, Artificial Sequence
  CXCR4 targeting guide RNA
guugcuguaugucucguggua

SEQ ID NO: 5760 - RNA, 21 nt, Artificial Sequence
  CXCR4 targeting guide RNA
guuggauuuuugucuuguguu

SEQ ID NO: 5761 - RNA, 21 nt, Artificial Sequence
  CXCR4 targeting guide RNA
guuucauauugaugugugucu

SEQ ID NO: 5762 - RNA, 21 nt, Artificial Sequence
  CXCR4 targeting guide RNA
guuuucaggaguggguugauu

SEQ ID NO: 5763 - RNA, 21 nt, Artificial Sequence
  CXCR4 targeting guide RNA
guuuuucaguuuucaggagug

SEQ ID NO: 5764 - RNA, 21 nt, Artificial Sequence
  CXCR4 targeting guide RNA
guuuuuccuguucuuaagacg

SEQ ID NO: 5765 - RNA, 21 nt, Artificial Sequence
  CXCR4 targeting guide RNA
uaaacagcuggggaucauuuc

SEQ ID NO: 5766 - RNA, 21 nt, Artificial Sequence
  CXCR4 targeting guide RNA
uaaagcuagaaaugaucccca

SEQ ID NO: 5767 - RNA, 21 nt, Artificial Sequence
  CXCR4 targeting guide RNA
uaaccaaagcccaaaguggua

SEQ ID NO: 5768 - RNA, 21 nt, Artificial Sequence
  CXCR4 targeting guide RNA
uaagaacaggaaaaacguucc

SEQ ID NO: 5769 - RNA, 21 nt, Artificial Sequence
  CXCR4 targeting guide RNA
uaagaacuuggccacaggucc

SEQ ID NO: 5770 - RNA, 21 nt, Artificial Sequence
  CXCR4 targeting guide RNA
uaagacgugauuuugcuguag

SEQ ID NO: 5771 - RNA, 21 nt, Artificial Sequence
  CXCR4 targeting guide RNA
uaagugccaucuucuacagca

SEQ ID NO: 5772 - RNA, 21 nt, Artificial Sequence
  CXCR4 targeting guide RNA
uaauacaagacuguacacugu

SEQ ID NO: 5773 - RNA, 21 nt, Artificial Sequence
  CXCR4 targeting guide RNA
uaaucucuccauucccgugga

SEQ ID NO: 5774 - RNA, 21 nt, Artificial Sequence
  CXCR4 targeting guide RNA
uacaagacuguacacuguagg

SEQ ID NO: 5775 - RNA, 21 nt, Artificial Sequence
  CXCR4 targeting guide RNA
uacacgcucuggaauguucag

SEQ ID NO: 5776 - RNA, 21 nt, Artificial Sequence
  CXCR4 targeting guide RNA
uacacuguaggugcugaaauc

SEQ ID NO: 5777 - RNA, 21 nt, Artificial Sequence
  CXCR4 targeting guide RNA
uacagcaaaaucacgucuuaa

SEQ ID NO: 5778 - RNA, 21 nt, Artificial Sequence
  CXCR4 targeting guide RNA
uacagcaacuaagaacuuggc

SEQ ID NO: 5779 - RNA, 21 nt, Artificial Sequence
  CXCR4 targeting guide RNA
uacaguccuaccacgagacau

SEQ ID NO: 5780 - RNA, 21 nt, Artificial Sequence
  CXCR4 targeting guide RNA
uacaguguacagucuuguauu

SEQ ID NO: 5781 - RNA, 21 nt, Artificial Sequence
  CXCR4 targeting guide RNA
uaccacgagacauacagcaac

SEQ ID NO: 5782 - RNA, 21 nt, Artificial Sequence
  CXCR4 targeting guide RNA
uaccacuuugggcuuugguua

SEQ ID NO: 5783 - RNA, 21 nt, Artificial Sequence
  CXCR4 targeting guide RNA
uacgugauucacuacacgcuc

SEQ ID NO: 5784 - RNA, 21 nt, Artificial Sequence
  CXCR4 targeting guide RNA
uagaaaagggaacugaacauu

SEQ ID NO: 5785 - RNA, 21 nt, Artificial Sequence
  CXCR4 targeting guide RNA
uagaaaugauccccagcuguu

SEQ ID NO: 5786 - RNA, 21 nt, Artificial Sequence
  CXCR4 targeting guide RNA
uagaaaugcugguuuuucagu

SEQ ID NO: 5787 - RNA, 21 nt, Artificial Sequence
  CXCR4 targeting guide RNA
uagaagauggcacuuauaacc

SEQ ID NO: 5788 - RNA, 21 nt, Artificial Sequence
  CXCR4 targeting guide RNA
uagauaaucucuccauucccg

SEQ ID NO: 5789 - RNA, 21 nt, Artificial Sequence
  CXCR4 targeting guide RNA
uagcuuuacgugauucacuac

SEQ ID NO: 5790 - RNA, 21 nt, Artificial Sequence
  CXCR4 targeting guide RNA
uaggacuguagaaaagggaac

SEQ ID NO: 5791 - RNA, 21 nt, Artificial Sequence
  CXCR4 targeting guide RNA
uaggcaggaccuguggccaag

SEQ ID NO: 5792 - RNA, 21 nt, Artificial Sequence
  CXCR4 targeting guide RNA
uaggugcugaaaucaacccac

SEQ ID NO: 5793 - RNA, 21 nt, Artificial Sequence
  CXCR4 targeting guide RNA
uagugaaucacguaaagcuag

SEQ ID NO: 5794 - RNA, 21 nt, Artificial Sequence
  CXCR4 targeting guide RNA
uaguugcuguaugucucgugg

SEQ ID NO: 5795 - RNA, 21 nt, Artificial Sequence
  CXCR4 targeting guide RNA
uauaaccaaagcccaaagugg

SEQ ID NO: 5796 - RNA, 21 nt, Artificial Sequence
  CXCR4 targeting guide RNA
uauaagugccaucuucuacag

SEQ ID NO: 5797 - RNA, 21 nt, Artificial Sequence
  CXCR4 targeting guide RNA
uauaccacuuugggcuuuggu

SEQ ID NO: 5798 - RNA, 21 nt, Artificial Sequence
  CXCR4 targeting guide RNA
uaucuaugcauaaacagcugg

SEQ ID NO: 5799 - RNA, 21 nt, Artificial Sequence
  CXCR4 targeting guide RNA
uaugcauaaacagcuggggau

SEQ ID NO: 5800 - RNA, 21 nt, Artificial Sequence
  CXCR4 targeting guide RNA
uaugcauagauaaucucucca

SEQ ID NO: 5801 - RNA, 21 nt, Artificial Sequence
  CXCR4 targeting guide RNA
uaugucucgugguaggacugu

SEQ ID NO: 5802 - RNA, 21 nt, Artificial Sequence
  CXCR4 targeting guide RNA
uauugaugugugucuaggcag

SEQ ID NO: 5803 - RNA, 21 nt, Artificial Sequence
  CXCR4 targeting guide RNA
ucaacccacuccugaaaacug

SEQ ID NO: 5804 - RNA, 21 nt, Artificial Sequence
  CXCR4 targeting guide RNA
ucacguaaagcuagaaaugau

SEQ ID NO: 5805 - RNA, 21 nt, Artificial Sequence
  CXCR4 targeting guide RNA
ucacgucuuaagaacaggaaa

SEQ ID NO: 5806 - RNA, 21 nt, Artificial Sequence
  CXCR4 targeting guide RNA
ucacuacacgcucuggaaugu

SEQ ID NO: 5807 - RNA, 21 nt, Artificial Sequence
  CXCR4 targeting guide RNA
ucagauauaaaagacugacca

SEQ ID NO: 5808 - RNA, 21 nt, Artificial Sequence
  CXCR4 targeting guide RNA
ucagcaccuacaguguacagu

SEQ ID NO: 5809 - RNA, 21 nt, Artificial Sequence
  CXCR4 targeting guide RNA
ucaggaguggguugauuucag

SEQ ID NO: 5810 - RNA, 21 nt, Artificial Sequence
  CXCR4 targeting guide RNA
ucaguucccuuuucuacaguc

SEQ ID NO: 5811 - RNA, 21 nt, Artificial Sequence
  CXCR4 targeting guide RNA
ucaguuuucaggaguggguug

SEQ ID NO: 5812 - RNA, 21 nt, Artificial Sequence
  CXCR4 targeting guide RNA
ucauauugaugugugucuagg

SEQ ID NO: 5813 - RNA, 21 nt, Artificial Sequence
  CXCR4 targeting guide RNA
ucauuucuagcuuuacgugau

SEQ ID NO: 5814 - RNA, 21 nt, Artificial Sequence
  CXCR4 targeting guide RNA
uccaacaagcaauaaaaacug

SEQ ID NO: 5815 - RNA, 21 nt, Artificial Sequence
  CXCR4 targeting guide RNA
uccacgggaauggagagauua

SEQ ID NO: 5816 - RNA, 21 nt, Artificial Sequence
  CXCR4 targeting guide RNA
uccagagcguguagugaauca

SEQ ID NO: 5817 - RNA, 21 nt, Artificial Sequence
  CXCR4 targeting guide RNA
uccauucccguggaacguuuu

SEQ ID NO: 5818 - RNA, 21 nt, Artificial Sequence
  CXCR4 targeting guide RNA
uccccagcuguuuaugcauag

SEQ ID NO: 5819 - RNA, 21 nt, Artificial Sequence
  CXCR4 targeting guide RNA
ucccguggaacguuuuuccug

SEQ ID NO: 5820 - RNA, 21 nt, Artificial Sequence
  CXCR4 targeting guide RNA
ucccuuuucuacaguccuacc

SEQ ID NO: 5821 - RNA, 21 nt, Artificial Sequence
  CXCR4 targeting guide RNA
uccuaccacgagacauacagc

SEQ ID NO: 5822 - RNA, 21 nt, Artificial Sequence
  CXCR4 targeting guide RNA
uccugaaaacugaaaaaccag

SEQ ID NO: 5823 - RNA, 21 nt, Artificial Sequence
  CXCR4 targeting guide RNA
uccugccuagacacacaucaa

SEQ ID NO: 5824 - RNA, 21 nt, Artificial Sequence
  CXCR4 targeting guide RNA
uccuguucuuaagacgugauu

SEQ ID NO: 5825 - RNA, 21 nt, Artificial Sequence
  CXCR4 targeting guide RNA
ucgugguaggacuguagaaaa

SEQ ID NO: 5826 - RNA, 21 nt, Artificial Sequence
  CXCR4 targeting guide RNA
ucuacagcaaaaucacgucuu

SEQ ID NO: 5827 - RNA, 21 nt, Artificial Sequence
  CXCR4 targeting guide RNA
ucuacaguccuaccacgagac

SEQ ID NO: 5828 - RNA, 21 nt, Artificial Sequence
  CXCR4 targeting guide RNA
ucuagcuuuacgugauucacu

SEQ ID NO: 5829 - RNA, 21 nt, Artificial Sequence
  CXCR4 targeting guide RNA
ucuaggcaggaccuguggcca

SEQ ID NO: 5830 - RNA, 21 nt, Artificial Sequence
  CXCR4 targeting guide RNA
ucuauaccacuuugggcuuug

SEQ ID NO: 5831 - RNA, 21 nt, Artificial Sequence
  CXCR4 targeting guide RNA
ucuaugcauaaacagcugggg

SEQ ID NO: 5832 - RNA, 21 nt, Artificial Sequence
  CXCR4 targeting guide RNA
ucuccauucccguggaacguu

SEQ ID NO: 5833 - RNA, 21 nt, Artificial Sequence
  CXCR4 targeting guide RNA
ucucgugguaggacuguagaa

SEQ ID NO: 5834 - RNA, 21 nt, Artificial Sequence
  CXCR4 targeting guide RNA
ucucuccauucccguggaacg

SEQ ID NO: 5835 - RNA, 21 nt, Artificial Sequence
  CXCR4 targeting guide RNA
ucuggaauguucaguucccuu

SEQ ID NO: 5836 - RNA, 21 nt, Artificial Sequence
  CXCR4 targeting guide RNA
ucuuaagaacaggaaaaacgu

SEQ ID NO: 5837 - RNA, 21 nt, Artificial Sequence
  CXCR4 targeting guide RNA
ucuuaagacgugauuuugcug

SEQ ID NO: 5838 - RNA, 21 nt, Artificial Sequence
  CXCR4 targeting guide RNA
ucuuaguugcuguaugucucg

SEQ ID NO: 5839 - RNA, 21 nt, Artificial Sequence
  CXCR4 targeting guide RNA
ucuucuacagcaaaaucacgu

SEQ ID NO: 5840 - RNA, 21 nt, Artificial Sequence
  CXCR4 targeting guide RNA
ugaaaacugaaaaaccagcau

SEQ ID NO: 5841 - RNA, 21 nt, Artificial Sequence
  CXCR4 targeting guide RNA
ugaaaucaacccacuccugaa

SEQ ID NO: 5842 - RNA, 21 nt, Artificial Sequence
  CXCR4 targeting guide RNA
ugaacauuccagagcguguag

SEQ ID NO: 5843 - RNA, 21 nt, Artificial Sequence
  CXCR4 targeting guide RNA
ugaaucacguaaagcuagaaa

SEQ ID NO: 5844 - RNA, 21 nt, Artificial Sequence
  CXCR4 targeting guide RNA
ugauccccagcuguuuaugca

SEQ ID NO: 5845 - RNA, 21 nt, Artificial Sequence
  CXCR4 targeting guide RNA
ugaugugugucuaggcaggac

SEQ ID NO: 5846 - RNA, 21 nt, Artificial Sequence
  CXCR4 targeting guide RNA
ugauucacuacacgcucugga

SEQ ID NO: 5847 - RNA, 21 nt, Artificial Sequence
  CXCR4 targeting guide RNA
ugauuucagcaccuacagugu

SEQ ID NO: 5848 - RNA, 21 nt, Artificial Sequence
  CXCR4 targeting guide RNA
ugauuuugcuguagaagaugg

SEQ ID NO: 5849 - RNA, 21 nt, Artificial Sequence
  CXCR4 targeting guide RNA
ugcauaaacagcuggggauca

SEQ ID NO: 5850 - RNA, 21 nt, Artificial Sequence
  CXCR4 targeting guide RNA
ugcauagauaaucucuccauu

SEQ ID NO: 5851 - RNA, 21 nt, Artificial Sequence
  CXCR4 targeting guide RNA
ugccaucuucuacagcaaaau

SEQ ID NO: 5852 - RNA, 21 nt, Artificial Sequence
  CXCR4 targeting guide RNA
ugccuagacacacaucaauau

SEQ ID NO: 5853 - RNA, 21 nt, Artificial Sequence
  CXCR4 targeting guide RNA
ugcugaaaucaacccacuccu

SEQ ID NO: 5854 - RNA, 21 nt, Artificial Sequence
  CXCR4 targeting guide RNA
ugcugguuuuucaguuuucag

SEQ ID NO: 5855 - RNA, 21 nt, Artificial Sequence
  CXCR4 targeting guide RNA
ugcuguagaagauggcacuua

SEQ ID NO: 5856 - RNA, 21 nt, Artificial Sequence
  CXCR4 targeting guide RNA
ugcuguaugucucgugguagg

SEQ ID NO: 5857 - RNA, 21 nt, Artificial Sequence
  CXCR4 targeting guide RNA
ugcuuguuggauuuuugucuu

SEQ ID NO: 5858 - RNA, 21 nt, Artificial Sequence
  CXCR4 targeting guide RNA
uggaacguuuuuccuguucuu

SEQ ID NO: 5859 - RNA, 21 nt, Artificial Sequence
  CXCR4 targeting guide RNA
uggaauguucaguucccuuuu

SEQ ID NO: 5860 - RNA, 21 nt, Artificial Sequence
  CXCR4 targeting guide RNA
uggagagauuaucuaugcaua

SEQ ID NO: 5861 - RNA, 21 nt, Artificial Sequence
  CXCR4 targeting guide RNA
uggauuuuugucuuguguuuc

SEQ ID NO: 5862 - RNA, 21 nt, Artificial Sequence
  CXCR4 targeting guide RNA
uggcacuuauaaccaaagccc

SEQ ID NO: 5863 - RNA, 21 nt, Artificial Sequence
  CXCR4 targeting guide RNA
uggccaaguucuuaguugcug

SEQ ID NO: 5864 - RNA, 21 nt, Artificial Sequence
  CXCR4 targeting guide RNA
uggccacagguccugccuaga

SEQ ID NO: 5865 - RNA, 21 nt, Artificial Sequence
  CXCR4 targeting guide RNA
ugggcuuugguuauaagugcc

SEQ ID NO: 5866 - RNA, 21 nt, Artificial Sequence
  CXCR4 targeting guide RNA
uggggaucauuucuagcuuua

SEQ ID NO: 5867 - RNA, 21 nt, Artificial Sequence
  CXCR4 targeting guide RNA
uggguugauuucagcaccuac

SEQ ID NO: 5868 - RNA, 21 nt, Artificial Sequence
  CXCR4 targeting guide RNA
ugguaggacuguagaaaaggg

SEQ ID NO: 5869 - RNA, 21 nt, Artificial Sequence
  CXCR4 targeting guide RNA
ugguauagaaaugcugguuuu

SEQ ID NO: 5870 - RNA, 21 nt, Artificial Sequence
  CXCR4 targeting guide RNA
uggucagucuuuuauaucuga

SEQ ID NO: 5871 - RNA, 21 nt, Artificial Sequence
  CXCR4 targeting guide RNA
ugguuauaagugccaucuucu

SEQ ID NO: 5872 - RNA, 21 nt, Artificial Sequence
  CXCR4 targeting guide RNA
ugguuuuucaguuuucaggag

SEQ ID NO: 5873 - RNA, 21 nt, Artificial Sequence
  CXCR4 targeting guide RNA
uguacaauauuggucagucuu

SEQ ID NO: 5874 - RNA, 21 nt, Artificial Sequence
  CXCR4 targeting guide RNA
uguacacuguaggugcugaaa

SEQ ID NO: 5875 - RNA, 21 nt, Artificial Sequence
  CXCR4 targeting guide RNA
uguagaaaagggaacugaaca

SEQ ID NO: 5876 - RNA, 21 nt, Artificial Sequence
  CXCR4 targeting guide RNA
uguagaagauggcacuuauaa

SEQ ID NO: 5877 - RNA, 21 nt, Artificial Sequence
  CXCR4 targeting guide RNA
uguaggugcugaaaucaaccc

SEQ ID NO: 5878 - RNA, 21 nt, Artificial Sequence
  CXCR4 targeting guide RNA
uguagugaaucacguaaagcu

SEQ ID NO: 5879 - RNA, 21 nt, Artificial Sequence
  CXCR4 targeting guide RNA
uguaugucucgugguaggacu

SEQ ID NO: 5880 - RNA, 21 nt, Artificial Sequence
  CXCR4 targeting guide RNA
ugucuaggcaggaccuguggc

SEQ ID NO: 5881 - RNA, 21 nt, Artificial Sequence
  CXCR4 targeting guide RNA
ugucucgugguaggacuguag

SEQ ID NO: 5882 - RNA, 21 nt, Artificial Sequence
  CXCR4 targeting guide RNA
uguggccaaguucuuaguugc

SEQ ID NO: 5883 - RNA, 21 nt, Artificial Sequence
  CXCR4 targeting guide RNA
ugugucuaggcaggaccugug

SEQ ID NO: 5884 - RNA, 21 nt, Artificial Sequence
  CXCR4 targeting guide RNA
ugugugucuaggcaggaccug

SEQ ID NO: 5885 - RNA, 21 nt, Artificial Sequence
  CXCR4 targeting guide RNA
uguucaguucccuuuucuaca

SEQ ID NO: 5886 - RNA, 21 nt, Artificial Sequence
  CXCR4 targeting guide RNA
uguucuuaagacgugauuuug

SEQ ID NO: 5887 - RNA, 21 nt, Artificial Sequence
  CXCR4 targeting guide RNA
uguuggauuuuugucuugugu

SEQ ID NO: 5888 - RNA, 21 nt, Artificial Sequence
  CXCR4 targeting guide RNA
uguuucauauugauguguguc

SEQ ID NO: 5889 - RNA, 21 nt, Artificial Sequence
  CXCR4 targeting guide RNA
uuaagaacaggaaaaacguuc

SEQ ID NO: 5890 - RNA, 21 nt, Artificial Sequence
  CXCR4 targeting guide RNA
uuaagacgugauuuugcugua

SEQ ID NO: 5891 - RNA, 21 nt, Artificial Sequence
  CXCR4 targeting guide RNA
uuaauacaagacuguacacug

SEQ ID NO: 5892 - RNA, 21 nt, Artificial Sequence
  CXCR4 targeting guide RNA
uuacgugauucacuacacgcu

SEQ ID NO: 5893 - RNA, 21 nt, Artificial Sequence
  CXCR4 targeting guide RNA
uuaguugcuguaugucucgug

SEQ ID NO: 5894 - RNA, 21 nt, Artificial Sequence
  CXCR4 targeting guide RNA
uuauaaccaaagcccaaagug

SEQ ID NO: 5895 - RNA, 21 nt, Artificial Sequence
  CXCR4 targeting guide RNA
uuauaagugccaucuucuaca

SEQ ID NO: 5896 - RNA, 21 nt, Artificial Sequence
  CXCR4 targeting guide RNA
uuaucuaugcauaaacagcug

SEQ ID NO: 5897 - RNA, 21 nt, Artificial Sequence
  CXCR4 targeting guide RNA
uuaugcauagauaaucucucc

SEQ ID NO: 5898 - RNA, 21 nt, Artificial Sequence
  CXCR4 targeting guide RNA
uucacuacacgcucuggaaug

SEQ ID NO: 5899 - RNA, 21 nt, Artificial Sequence
  CXCR4 targeting guide RNA
uucagauauaaaagacugacc

SEQ ID NO: 5900 - RNA, 21 nt, Artificial Sequence
  CXCR4 targeting guide RNA
uucagcaccuacaguguacag

SEQ ID NO: 5901 - RNA, 21 nt, Artificial Sequence
  CXCR4 targeting guide RNA
uucaggaguggguugauuuca

SEQ ID NO: 5902 - RNA, 21 nt, Artificial Sequence
  CXCR4 targeting guide RNA
uucaguucccuuuucuacagu

SEQ ID NO: 5903 - RNA, 21 nt, Artificial Sequence
  CXCR4 targeting guide RNA
uucaguuuucaggaguggguu

SEQ ID NO: 5904 - RNA, 21 nt, Artificial Sequence
  CXCR4 targeting guide RNA
uucauauugaugugugucuag

SEQ ID NO: 5905 - RNA, 21 nt, Artificial Sequence
  CXCR4 targeting guide RNA
uuccacgggaauggagagauu

SEQ ID NO: 5906 - RNA, 21 nt, Artificial Sequence
  CXCR4 targeting guide RNA
uuccagagcguguagugaauc

SEQ ID NO: 5907 - RNA, 21 nt, Artificial Sequence
  CXCR4 targeting guide RNA
uucccguggaacguuuuuccu

SEQ ID NO: 5908 - RNA, 21 nt, Artificial Sequence
  CXCR4 targeting guide RNA
uucccuuuucuacaguccuac

SEQ ID NO: 5909 - RNA, 21 nt, Artificial Sequence
  CXCR4 targeting guide RNA
uuccuguucuuaagacgugau

SEQ ID NO: 5910 - RNA, 21 nt, Artificial Sequence
  CXCR4 targeting guide RNA
uucuacagcaaaaucacgucu

SEQ ID NO: 5911 - RNA, 21 nt, Artificial Sequence
  CXCR4 targeting guide RNA
uucuacaguccuaccacgaga

SEQ ID NO: 5912 - RNA, 21 nt, Artificial Sequence
  CXCR4 targeting guide RNA
uucuagcuuuacgugauucac

SEQ ID NO: 5913 - RNA, 21 nt, Artificial Sequence
  CXCR4 targeting guide RNA
uucuauaccacuuugggcuuu

SEQ ID NO: 5914 - RNA, 21 nt, Artificial Sequence
  CXCR4 targeting guide RNA
uucuuaagacgugauuuugcu

SEQ ID NO: 5915 - RNA, 21 nt, Artificial Sequence
  CXCR4 targeting guide RNA
uucuuaguugcuguaugucuc

SEQ ID NO: 5916 - RNA, 21 nt, Artificial Sequence
  CXCR4 targeting guide RNA
uugaugugugucuaggcagga

SEQ ID NO: 5917 - RNA, 21 nt, Artificial Sequence
  CXCR4 targeting guide RNA
uugauuucagcaccuacagug

SEQ ID NO: 5918 - RNA, 21 nt, Artificial Sequence
  CXCR4 targeting guide RNA
uugcuguagaagauggcacuu

SEQ ID NO: 5919 - RNA, 21 nt, Artificial Sequence
  CXCR4 targeting guide RNA
uugcuguaugucucgugguag

SEQ ID NO: 5920 - RNA, 21 nt, Artificial Sequence
  CXCR4 targeting guide RNA
uugcuuguuggauuuuugucu

SEQ ID NO: 5921 - RNA, 21 nt, Artificial Sequence
  CXCR4 targeting guide RNA
uuggccacagguccugccuag

SEQ ID NO: 5922 - RNA, 21 nt, Artificial Sequence
  CXCR4 targeting guide RNA
uugggcuuugguuauaagugc

SEQ ID NO: 5923 - RNA, 21 nt, Artificial Sequence
  CXCR4 targeting guide RNA
uuggucagucuuuuauaucug

SEQ ID NO: 5924 - RNA, 21 nt, Artificial Sequence
  CXCR4 targeting guide RNA
uugguuauaagugccaucuuc

SEQ ID NO: 5925 - RNA, 21 nt, Artificial Sequence
  CXCR4 targeting guide RNA
uuguuggauuuuugucuugug

SEQ ID NO: 5926 - RNA, 21 nt, Artificial Sequence
  CXCR4 targeting guide RNA
uuuacgugauucacuacacgc

SEQ ID NO: 5927 - RNA, 21 nt, Artificial Sequence
  CXCR4 targeting guide RNA
uuucagcaccuacaguguaca

SEQ ID NO: 5928 - RNA, 21 nt, Artificial Sequence
  CXCR4 targeting guide RNA
uuucaggaguggguugauuuc

SEQ ID NO: 5929 - RNA, 21 nt, Artificial Sequence
  CXCR4 targeting guide RNA
uuucaguuuucaggagugggu

SEQ ID NO: 5930 - RNA, 21 nt, Artificial Sequence
  CXCR4 targeting guide RNA
uuuccuguucuuaagacguga

SEQ ID NO: 5931 - RNA, 21 nt, Artificial Sequence
  CXCR4 targeting guide RNA
uuucuacaguccuaccacgag

SEQ ID NO: 5932 - RNA, 21 nt, Artificial Sequence
  CXCR4 targeting guide RNA
uuucuagcuuuacgugauuca

SEQ ID NO: 5933 - RNA, 21 nt, Artificial Sequence
  CXCR4 targeting guide RNA
uuucuauaccacuuugggcuu

SEQ ID NO: 5934 - RNA, 21 nt, Artificial Sequence
  CXCR4 targeting guide RNA
uuugcuguagaagauggcacu

SEQ ID NO: 5935 - RNA, 21 nt, Artificial Sequence
  CXCR4 targeting guide RNA
uuugggcuuugguuauaagug

SEQ ID NO: 5936 - RNA, 21 nt, Artificial Sequence
  CXCR4 targeting guide RNA
uuugguuauaagugccaucuu

SEQ ID NO: 5937 - RNA, 21 nt, Artificial Sequence
  CXCR4 targeting guide RNA
uuuucaggaguggguugauuu

SEQ ID NO: 5938 - RNA, 21 nt, Artificial Sequence
  CXCR4 targeting guide RNA
uuuucaguuuucaggaguggg

SEQ ID NO: 5939 - RNA, 21 nt, Artificial Sequence
  CXCR4 targeting guide RNA
uuuuccuguucuuaagacgug

SEQ ID NO: 5940 - RNA, 21 nt, Artificial Sequence
  CXCR4 targeting guide RNA
uuuucuacaguccuaccacga

SEQ ID NO: 5941 - RNA, 21 nt, Artificial Sequence
  CXCR4 targeting guide RNA
uuuugcuguagaagauggcac

SEQ ID NO: 5942 - RNA, 21 nt, Artificial Sequence
  CXCR4 targeting guide RNA
uuuuucaguuuucaggagugg

SEQ ID NO: 5943 - RNA, 21 nt, Artificial Sequence
  CXCR4 targeting guide RNA
uuuuuccuguucuuaagacgu

SEQ ID NO: 5944 - RNA, 22 nt, Artificial Sequence
  CXCR4 targeting guide RNA
aaaaaccagcauuucuauacca

SEQ ID NO: 5945 - RNA, 22 nt, Artificial Sequence
  CXCR4 targeting guide RNA
aaaaacguuccacgggaaugga

SEQ ID NO: 5946 - RNA, 22 nt, Artificial Sequence
  CXCR4 targeting guide RNA
aaaaccagcauuucuauaccac

SEQ ID NO: 5947 - RNA, 22 nt, Artificial Sequence
  CXCR4 targeting guide RNA
aaaacguuccacgggaauggag

SEQ ID NO: 5948 - RNA, 22 nt, Artificial Sequence
  CXCR4 targeting guide RNA
aaaacugaaaaaccagcauuuc

SEQ ID NO: 5949 - RNA, 22 nt, Artificial Sequence
  CXCR4 targeting guide RNA
aaaacuguacaauauuggucag

SEQ ID NO: 5950 - RNA, 22 nt, Artificial Sequence
  CXCR4 targeting guide RNA
aaaagacugaccaauauuguac

SEQ ID NO: 5951 - RNA, 22 nt, Artificial Sequence
  CXCR4 targeting guide RNA
aaaagggaacugaacauuccag

SEQ ID NO: 5952 - RNA, 22 nt, Artificial Sequence
  CXCR4 targeting guide RNA
aaaaucacgucuuaagaacagg

SEQ ID NO: 5953 - RNA, 22 nt, Artificial Sequence
  CXCR4 targeting guide RNA
aaacacaagacaaaaauccaac

SEQ ID NO: 5954 - RNA, 22 nt, Artificial Sequence
  CXCR4 targeting guide RNA
aaacagcuggggaucauuucua

SEQ ID NO: 5955 - RNA, 22 nt, Artificial Sequence
  CXCR4 targeting guide RNA
aaaccagcauuucuauaccacu

SEQ ID NO: 5956 - RNA, 22 nt, Artificial Sequence
  CXCR4 targeting guide RNA
aaacguuccacgggaauggaga

SEQ ID NO: 5957 - RNA, 22 nt, Artificial Sequence
  CXCR4 targeting guide RNA
aaacugaaaaaccagcauuucu

SEQ ID NO: 5958 - RNA, 22 nt, Artificial Sequence
  CXCR4 targeting guide RNA
aaacuguacaauauuggucagu

SEQ ID NO: 5959 - RNA, 22 nt, Artificial Sequence
  CXCR4 targeting guide RNA
aaagacugaccaauauuguaca

SEQ ID NO: 5960 - RNA, 22 nt, Artificial Sequence
  CXCR4 targeting guide RNA
aaagcccaaagugguauagaaa

SEQ ID NO: 5961 - RNA, 22 nt, Artificial Sequence
  CXCR4 targeting guide RNA
aaagcuagaaaugauccccagc

SEQ ID NO: 5962 - RNA, 22 nt, Artificial Sequence
  CXCR4 targeting guide RNA
aaagggaacugaacauuccaga

SEQ ID NO: 5963 - RNA, 22 nt, Artificial Sequence
  CXCR4 targeting guide RNA
aaagugguauagaaaugcuggu

SEQ ID NO: 5964 - RNA, 22 nt, Artificial Sequence
  CXCR4 targeting guide RNA
aaaucaacccacuccugaaaac

SEQ ID NO: 5965 - RNA, 22 nt, Artificial Sequence
  CXCR4 targeting guide RNA
aaaucacgucuuaagaacagga

SEQ ID NO: 5966 - RNA, 22 nt, Artificial Sequence
  CXCR4 targeting guide RNA
aaaugauccccagcuguuuaug

SEQ ID NO: 5967 - RNA, 22 nt, Artificial Sequence
  CXCR4 targeting guide RNA
aaaugcugguuuuucaguuuuc

SEQ ID NO: 5968 - RNA, 22 nt, Artificial Sequence
  CXCR4 targeting guide RNA
aacacaagacaaaaauccaaca

SEQ ID NO: 5969 - RNA, 22 nt, Artificial Sequence
  CXCR4 targeting guide RNA
aacagcuggggaucauuucuag

SEQ ID NO: 5970 - RNA, 22 nt, Artificial Sequence
  CXCR4 targeting guide RNA
aacaggaaaaacguuccacggg

SEQ ID NO: 5971 - RNA, 22 nt, Artificial Sequence
  CXCR4 targeting guide RNA
aacauuccagagcguguaguga

SEQ ID NO: 5972 - RNA, 22 nt, Artificial Sequence
  CXCR4 targeting guide RNA
aaccaaagcccaaagugguaua

SEQ ID NO: 5973 - RNA, 22 nt, Artificial Sequence
  CXCR4 targeting guide RNA
aaccagcauuucuauaccacuu

SEQ ID NO: 5974 - RNA, 22 nt, Artificial Sequence
  CXCR4 targeting guide RNA
aacccacuccugaaaacugaaa

SEQ ID NO: 5975 - RNA, 22 nt, Artificial Sequence
  CXCR4 targeting guide RNA
aacguuccacgggaauggagag

SEQ ID NO: 5976 - RNA, 22 nt, Artificial Sequence
  CXCR4 targeting guide RNA
aacguuuuuccuguucuuaaga

SEQ ID NO: 5977 - RNA, 22 nt, Artificial Sequence
  CXCR4 targeting guide RNA
aacuaagaacuuggccacaggu

SEQ ID NO: 5978 - RNA, 22 nt, Artificial Sequence
  CXCR4 targeting guide RNA
aacugaaaaaccagcauuucua

SEQ ID NO: 5979 - RNA, 22 nt, Artificial Sequence
  CXCR4 targeting guide RNA
aacugaacauuccagagcgugu

SEQ ID NO: 5980 - RNA, 22 nt, Artificial Sequence
  CXCR4 targeting guide RNA
aacuguacaauauuggucaguc

SEQ ID NO: 5981 - RNA, 22 nt, Artificial Sequence
  CXCR4 targeting guide RNA
aacuuaauacaagacuguacac

SEQ ID NO: 5982 - RNA, 22 nt, Artificial Sequence
  CXCR4 targeting guide RNA
aacuuggccacagguccugccu

SEQ ID NO: 5983 - RNA, 22 nt, Artificial Sequence
  CXCR4 targeting guide RNA
aagaaacacaagacaaaaaucc

SEQ ID NO: 5984 - RNA, 22 nt, Artificial Sequence
  CXCR4 targeting guide RNA
aagaacaggaaaaacguuccac

SEQ ID NO: 5985 - RNA, 22 nt, Artificial Sequence
  CXCR4 targeting guide RNA
aagaacuuggccacagguccug

SEQ ID NO: 5986 - RNA, 22 nt, Artificial Sequence
  CXCR4 targeting guide RNA
aagacaaaaauccaacaagcaa

SEQ ID NO: 5987 - RNA, 22 nt, Artificial Sequence
  CXCR4 targeting guide RNA
aagacgugauuuugcuguagaa

SEQ ID NO: 5988 - RNA, 22 nt, Artificial Sequence
  CXCR4 targeting guide RNA
aagacugaccaauauuguacag

SEQ ID NO: 5989 - RNA, 22 nt, Artificial Sequence
  CXCR4 targeting guide RNA
aagacuguacacuguaggugcu

SEQ ID NO: 5990 - RNA, 22 nt, Artificial Sequence
  CXCR4 targeting guide RNA
aagauggcacuuauaaccaaag

SEQ ID NO: 5991 - RNA, 22 nt, Artificial Sequence
  CXCR4 targeting guide RNA
aagcccaaagugguauagaaau

SEQ ID NO: 5992 - RNA, 22 nt, Artificial Sequence
  CXCR4 targeting guide RNA
aagcuagaaaugauccccagcu

SEQ ID NO: 5993 - RNA, 22 nt, Artificial Sequence
  CXCR4 targeting guide RNA
aagggaacugaacauuccagag

SEQ ID NO: 5994 - RNA, 22 nt, Artificial Sequence
  CXCR4 targeting guide RNA
aagugccaucuucuacagcaaa

SEQ ID NO: 5995 - RNA, 22 nt, Artificial Sequence
  CXCR4 targeting guide RNA
aagugguauagaaaugcugguu

SEQ ID NO: 5996 - RNA, 22 nt, Artificial Sequence
  CXCR4 targeting guide RNA
aaguucuuaguugcuguauguc

SEQ ID NO: 5997 - RNA, 22 nt, Artificial Sequence
  CXCR4 targeting guide RNA
aauacaagacuguacacuguag

SEQ ID NO: 5998 - RNA, 22 nt, Artificial Sequence
  CXCR4 targeting guide RNA
aaucaacccacuccugaaaacu

SEQ ID NO: 5999 - RNA, 22 nt, Artificial Sequence
  CXCR4 targeting guide RNA
aaucacguaaagcuagaaauga

SEQ ID NO: 6000 - RNA, 22 nt, Artificial Sequence
  CXCR4 targeting guide RNA
aaucacgucuuaagaacaggaa

SEQ ID NO: 6001 - RNA, 22 nt, Artificial Sequence
  CXCR4 targeting guide RNA
aaucucuccauucccguggaac

SEQ ID NO: 6002 - RNA, 22 nt, Artificial Sequence
  CXCR4 targeting guide RNA
aaugauccccagcuguuuaugc

SEQ ID NO: 6003 - RNA, 22 nt, Artificial Sequence
  CXCR4 targeting guide RNA
aaugcugguuuuucaguuuuca

SEQ ID NO: 6004 - RNA, 22 nt, Artificial Sequence
  CXCR4 targeting guide RNA
aauggagagauuaucuaugcau

SEQ ID NO: 6005 - RNA, 22 nt, Artificial Sequence
  CXCR4 targeting guide RNA
aauguucaguucccuuuucuac

SEQ ID NO: 6006 - RNA, 22 nt, Artificial Sequence
  CXCR4 targeting guide RNA
acaacuuaauacaagacuguac

SEQ ID NO: 6007 - RNA, 22 nt, Artificial Sequence
  CXCR4 targeting guide RNA
acaagacaaaaauccaacaagc

SEQ ID NO: 6008 - RNA, 22 nt, Artificial Sequence
  CXCR4 targeting guide RNA
acaagacuguacacuguaggug

SEQ ID NO: 6009 - RNA, 22 nt, Artificial Sequence
  CXCR4 targeting guide RNA
acacaagacaaaaauccaacaa

SEQ ID NO: 6010 - RNA, 22 nt, Artificial Sequence
  CXCR4 targeting guide RNA
acacgcucuggaauguucaguu

SEQ ID NO: 6011 - RNA, 22 nt, Artificial Sequence
  CXCR4 targeting guide RNA
acacuguaggugcugaaaucaa

SEQ ID NO: 6012 - RNA, 22 nt, Artificial Sequence
  CXCR4 targeting guide RNA
acagcaaaaucacgucuuaaga

SEQ ID NO: 6013 - RNA, 22 nt, Artificial Sequence
  CXCR4 targeting guide RNA
acagcaacuaagaacuuggcca

SEQ ID NO: 6014 - RNA, 22 nt, Artificial Sequence
  CXCR4 targeting guide RNA
acagcuggggaucauuucuagc

SEQ ID NO: 6015 - RNA, 22 nt, Artificial Sequence
  CXCR4 targeting guide RNA
acaggaaaaacguuccacggga

SEQ ID NO: 6016 - RNA, 22 nt, Artificial Sequence
  CXCR4 targeting guide RNA
acagguccugccuagacacaca

SEQ ID NO: 6017 - RNA, 22 nt, Artificial Sequence
  CXCR4 targeting guide RNA
acaguccuaccacgagacauac

SEQ ID NO: 6018 - RNA, 22 nt, Artificial Sequence
  CXCR4 targeting guide RNA
acaguguacagucuuguauuaa

SEQ ID NO: 6019 - RNA, 22 nt, Artificial Sequence
  CXCR4 targeting guide RNA
acaguuuuuauugcuuguugga

SEQ ID NO: 6020 - RNA, 22 nt, Artificial Sequence
  CXCR4 targeting guide RNA
acauacagcaacuaagaacuug

SEQ ID NO: 6021 - RNA, 22 nt, Artificial Sequence
  CXCR4 targeting guide RNA
acauuccagagcguguagugaa

SEQ ID NO: 6022 - RNA, 22 nt, Artificial Sequence
  CXCR4 targeting guide RNA
accaaagcccaaagugguauag

SEQ ID NO: 6023 - RNA, 22 nt, Artificial Sequence
  CXCR4 targeting guide RNA
accacgagacauacagcaacua

SEQ ID NO: 6024 - RNA, 22 nt, Artificial Sequence
  CXCR4 targeting guide RNA
accacuuugggcuuugguuaua

SEQ ID NO: 6025 - RNA, 22 nt, Artificial Sequence
  CXCR4 targeting guide RNA
accagcauuucuauaccacuuu

SEQ ID NO: 6026 - RNA, 22 nt, Artificial Sequence
  CXCR4 targeting guide RNA
acccacuccugaaaacugaaaa

SEQ ID NO: 6027 - RNA, 22 nt, Artificial Sequence
  CXCR4 targeting guide RNA
accuacaguguacagucuugua

SEQ ID NO: 6028 - RNA, 22 nt, Artificial Sequence
  CXCR4 targeting guide RNA
accuguggccaaguucuuaguu

SEQ ID NO: 6029 - RNA, 22 nt, Artificial Sequence
  CXCR4 targeting guide RNA
acgagacauacagcaacuaaga

SEQ ID NO: 6030 - RNA, 22 nt, Artificial Sequence
  CXCR4 targeting guide RNA
acgcucuggaauguucaguucc

SEQ ID NO: 6031 - RNA, 22 nt, Artificial Sequence
  CXCR4 targeting guide RNA
acgggaauggagagauuaucua

SEQ ID NO: 6032 - RNA, 22 nt, Artificial Sequence
  CXCR4 targeting guide RNA
acguaaagcuagaaaugauccc

SEQ ID NO: 6033 - RNA, 22 nt, Artificial Sequence
  CXCR4 targeting guide RNA
acgucuuaagaacaggaaaaac

SEQ ID NO: 6034 - RNA, 22 nt, Artificial Sequence
  CXCR4 targeting guide RNA
acgugauucacuacacgcucug

SEQ ID NO: 6035 - RNA, 22 nt, Artificial Sequence
  CXCR4 targeting guide RNA
acgugauuuugcuguagaagau

SEQ ID NO: 6036 - RNA, 22 nt, Artificial Sequence
  CXCR4 targeting guide RNA
acguuccacgggaauggagaga

SEQ ID NO: 6037 - RNA, 22 nt, Artificial Sequence
  CXCR4 targeting guide RNA
acguuuuuccuguucuuaagac

SEQ ID NO: 6038 - RNA, 22 nt, Artificial Sequence
  CXCR4 targeting guide RNA
acuaagaacuuggccacagguc

SEQ ID NO: 6039 - RNA, 22 nt, Artificial Sequence
  CXCR4 targeting guide RNA
acuacacgcucuggaauguuca

SEQ ID NO: 6040 - RNA, 22 nt, Artificial Sequence
  CXCR4 targeting guide RNA
acuccugaaaacugaaaaacca

SEQ ID NO: 6041 - RNA, 22 nt, Artificial Sequence
  CXCR4 targeting guide RNA
acugaaaaaccagcauuucuau

SEQ ID NO: 6042 - RNA, 22 nt, Artificial Sequence
  CXCR4 targeting guide RNA
acugaacauuccagagcgugua

SEQ ID NO: 6043 - RNA, 22 nt, Artificial Sequence
  CXCR4 targeting guide RNA
acugaccaauauuguacaguuu

SEQ ID NO: 6044 - RNA, 22 nt, Artificial Sequence
  CXCR4 targeting guide RNA
acuguacaauauuggucagucu

SEQ ID NO: 6045 - RNA, 22 nt, Artificial Sequence
  CXCR4 targeting guide RNA
acuguacacuguaggugcugaa

SEQ ID NO: 6046 - RNA, 22 nt, Artificial Sequence
  CXCR4 targeting guide RNA
acuguagaaaagggaacugaac

SEQ ID NO: 6047 - RNA, 22 nt, Artificial Sequence
  CXCR4 targeting guide RNA
acuguaggugcugaaaucaacc

SEQ ID NO: 6048 - RNA, 22 nt, Artificial Sequence
  CXCR4 targeting guide RNA
acuuaauacaagacuguacacu

SEQ ID NO: 6049 - RNA, 22 nt, Artificial Sequence
  CXCR4 targeting guide RNA
acuuauaaccaaagcccaaagu

SEQ ID NO: 6050 - RNA, 22 nt, Artificial Sequence
  CXCR4 targeting guide RNA
acuuggccacagguccugccua

SEQ ID NO: 6051 - RNA, 22 nt, Artificial Sequence
  CXCR4 targeting guide RNA
acuuugggcuuugguuauaagu

SEQ ID NO: 6052 - RNA, 22 nt, Artificial Sequence
  CXCR4 targeting guide RNA
agaaaagggaacugaacauucc

SEQ ID NO: 6053 - RNA, 22 nt, Artificial Sequence
  CXCR4 targeting guide RNA
agaaacacaagacaaaaaucca

SEQ ID NO: 6054 - RNA, 22 nt, Artificial Sequence
  CXCR4 targeting guide RNA
agaaaugauccccagcuguuua

SEQ ID NO: 6055 - RNA, 22 nt, Artificial Sequence
  CXCR4 targeting guide RNA
agaaaugcugguuuuucaguuu

SEQ ID NO: 6056 - RNA, 22 nt, Artificial Sequence
  CXCR4 targeting guide RNA
agaacaggaaaaacguuccacg

SEQ ID NO: 6057 - RNA, 22 nt, Artificial Sequence
  CXCR4 targeting guide RNA
agaacuuggccacagguccugc

SEQ ID NO: 6058 - RNA, 22 nt, Artificial Sequence
  CXCR4 targeting guide RNA
agaagauggcacuuauaaccaa

SEQ ID NO: 6059 - RNA, 22 nt, Artificial Sequence
  CXCR4 targeting guide RNA
agacaaaaauccaacaagcaau

SEQ ID NO: 6060 - RNA, 22 nt, Artificial Sequence
  CXCR4 targeting guide RNA
agacacacaucaauaugaaaca

SEQ ID NO: 6061 - RNA, 22 nt, Artificial Sequence
  CXCR4 targeting guide RNA
agacauacagcaacuaagaacu

SEQ ID NO: 6062 - RNA, 22 nt, Artificial Sequence
  CXCR4 targeting guide RNA
agacgugauuuugcuguagaag

SEQ ID NO: 6063 - RNA, 22 nt, Artificial Sequence
  CXCR4 targeting guide RNA
agacugaccaauauuguacagu

SEQ ID NO: 6064 - RNA, 22 nt, Artificial Sequence
  CXCR4 targeting guide RNA
agacuguacacuguaggugcug

SEQ ID NO: 6065 - RNA, 22 nt, Artificial Sequence
  CXCR4 targeting guide RNA
agagcguguagugaaucacgua

SEQ ID NO: 6066 - RNA, 22 nt, Artificial Sequence
  CXCR4 targeting guide RNA
agauaaucucuccauucccgug

SEQ ID NO: 6067 - RNA, 22 nt, Artificial Sequence
  CXCR4 targeting guide RNA
agauggcacuuauaaccaaagc

SEQ ID NO: 6068 - RNA, 22 nt, Artificial Sequence
  CXCR4 targeting guide RNA
agauuaucuaugcauaaacagc

SEQ ID NO: 6069 - RNA, 22 nt, Artificial Sequence
  CXCR4 targeting guide RNA
agcaaaaucacgucuuaagaac

SEQ ID NO: 6070 - RNA, 22 nt, Artificial Sequence
  CXCR4 targeting guide RNA
agcaacuaagaacuuggccaca

SEQ ID NO: 6071 - RNA, 22 nt, Artificial Sequence
  CXCR4 targeting guide RNA
agcaccuacaguguacagucuu

SEQ ID NO: 6072 - RNA, 22 nt, Artificial Sequence
  CXCR4 targeting guide RNA
agcauuucuauaccacuuuggg

SEQ ID NO: 6073 - RNA, 22 nt, Artificial Sequence
  CXCR4 targeting guide RNA
agcccaaagugguauagaaaug

SEQ ID NO: 6074 - RNA, 22 nt, Artificial Sequence
  CXCR4 targeting guide RNA
agcguguagugaaucacguaaa

SEQ ID NO: 6075 - RNA, 22 nt, Artificial Sequence
  CXCR4 targeting guide RNA
agcuagaaaugauccccagcug

SEQ ID NO: 6076 - RNA, 22 nt, Artificial Sequence
  CXCR4 targeting guide RNA
agcuggggaucauuucuagcuu

SEQ ID NO: 6077 - RNA, 22 nt, Artificial Sequence
  CXCR4 targeting guide RNA
agcuguuuaugcauagauaauc

SEQ ID NO: 6078 - RNA, 22 nt, Artificial Sequence
  CXCR4 targeting guide RNA
agcuuuacgugauucacuacac

SEQ ID NO: 6079 - RNA, 22 nt, Artificial Sequence
  CXCR4 targeting guide RNA
aggaaaaacguuccacgggaau

SEQ ID NO: 6080 - RNA, 22 nt, Artificial Sequence
  CXCR4 targeting guide RNA
aggaccuguggccaaguucuua

SEQ ID NO: 6081 - RNA, 22 nt, Artificial Sequence
  CXCR4 targeting guide RNA
aggacuguagaaaagggaacug

SEQ ID NO: 6082 - RNA, 22 nt, Artificial Sequence
  CXCR4 targeting guide RNA
aggaguggguugauuucagcac

SEQ ID NO: 6083 - RNA, 22 nt, Artificial Sequence
  CXCR4 targeting guide RNA
aggcaggaccuguggccaaguu

SEQ ID NO: 6084 - RNA, 22 nt, Artificial Sequence
  CXCR4 targeting guide RNA
agggaacugaacauuccagagc

SEQ ID NO: 6085 - RNA, 22 nt, Artificial Sequence
  CXCR4 targeting guide RNA
agguccugccuagacacacauc

SEQ ID NO: 6086 - RNA, 22 nt, Artificial Sequence
  CXCR4 targeting guide RNA
aggugcugaaaucaacccacuc

SEQ ID NO: 6087 - RNA, 22 nt, Artificial Sequence
  CXCR4 targeting guide RNA
aguccuaccacgagacauacag

SEQ ID NO: 6088 - RNA, 22 nt, Artificial Sequence
  CXCR4 targeting guide RNA
agugaaucacguaaagcuagaa

SEQ ID NO: 6089 - RNA, 22 nt, Artificial Sequence
  CXCR4 targeting guide RNA
agugccaucuucuacagcaaaa

SEQ ID NO: 6090 - RNA, 22 nt, Artificial Sequence
  CXCR4 targeting guide RNA
aguggguugauuucagcaccua

SEQ ID NO: 6091 - RNA, 22 nt, Artificial Sequence
  CXCR4 targeting guide RNA
agugguauagaaaugcugguuu

SEQ ID NO: 6092 - RNA, 22 nt, Artificial Sequence
  CXCR4 targeting guide RNA
aguguacagucuuguauuaagu

SEQ ID NO: 6093 - RNA, 22 nt, Artificial Sequence
  CXCR4 targeting guide RNA
aguucccuuuucuacaguccua

SEQ ID NO: 6094 - RNA, 22 nt, Artificial Sequence
  CXCR4 targeting guide RNA
aguucuuaguugcuguaugucu

SEQ ID NO: 6095 - RNA, 22 nt, Artificial Sequence
  CXCR4 targeting guide RNA
aguugcuguaugucucguggua

SEQ ID NO: 6096 - RNA, 22 nt, Artificial Sequence
  CXCR4 targeting guide RNA
aguuuucaggaguggguugauu

SEQ ID NO: 6097 - RNA, 22 nt, Artificial Sequence
  CXCR4 targeting guide RNA
auaaacagcuggggaucauuuc

SEQ ID NO: 6098 - RNA, 22 nt, Artificial Sequence
  CXCR4 targeting guide RNA
auaaccaaagcccaaaguggua

SEQ ID NO: 6099 - RNA, 22 nt, Artificial Sequence
  CXCR4 targeting guide RNA
auaagugccaucuucuacagca

SEQ ID NO: 6100 - RNA, 22 nt, Artificial Sequence
  CXCR4 targeting guide RNA
auaaucucuccauucccgugga

SEQ ID NO: 6101 - RNA, 22 nt, Artificial Sequence
  CXCR4 targeting guide RNA
auacaagacuguacacuguagg

SEQ ID NO: 6102 - RNA, 22 nt, Artificial Sequence
  CXCR4 targeting guide RNA
auacagcaacuaagaacuuggc

SEQ ID NO: 6103 - RNA, 22 nt, Artificial Sequence
  CXCR4 targeting guide RNA
auaccacuuugggcuuugguua

SEQ ID NO: 6104 - RNA, 22 nt, Artificial Sequence
  CXCR4 targeting guide RNA
auagaaaugcugguuuuucagu

SEQ ID NO: 6105 - RNA, 22 nt, Artificial Sequence
  CXCR4 targeting guide RNA
auagauaaucucuccauucccg

SEQ ID NO: 6106 - RNA, 22 nt, Artificial Sequence
  CXCR4 targeting guide RNA
auauugaugugugucuaggcag

SEQ ID NO: 6107 - RNA, 22 nt, Artificial Sequence
  CXCR4 targeting guide RNA
aucaacccacuccugaaaacug

SEQ ID NO: 6108 - RNA, 22 nt, Artificial Sequence
  CXCR4 targeting guide RNA
aucacguaaagcuagaaaugau

SEQ ID NO: 6109 - RNA, 22 nt, Artificial Sequence
  CXCR4 targeting guide RNA
aucacgucuuaagaacaggaaa

SEQ ID NO: 6110 - RNA, 22 nt, Artificial Sequence
  CXCR4 targeting guide RNA
aucauuucuagcuuuacgugau

SEQ ID NO: 6111 - RNA, 22 nt, Artificial Sequence
  CXCR4 targeting guide RNA
auccaacaagcaauaaaaacug

SEQ ID NO: 6112 - RNA, 22 nt, Artificial Sequence
  CXCR4 targeting guide RNA
auccccagcuguuuaugcauag

SEQ ID NO: 6113 - RNA, 22 nt, Artificial Sequence
  CXCR4 targeting guide RNA
aucuaugcauaaacagcugggg

SEQ ID NO: 6114 - RNA, 22 nt, Artificial Sequence
  CXCR4 targeting guide RNA
aucucuccauucccguggaacg

SEQ ID NO: 6115 - RNA, 22 nt, Artificial Sequence
  CXCR4 targeting guide RNA
aucuucuacagcaaaaucacgu

SEQ ID NO: 6116 - RNA, 22 nt, Artificial Sequence
  CXCR4 targeting guide RNA
augauccccagcuguuuaugca

SEQ ID NO: 6117 - RNA, 22 nt, Artificial Sequence
  CXCR4 targeting guide RNA
augcauaaacagcuggggauca

SEQ ID NO: 6118 - RNA, 22 nt, Artificial Sequence
  CXCR4 targeting guide RNA
augcauagauaaucucuccauu

SEQ ID NO: 6119 - RNA, 22 nt, Artificial Sequence
  CXCR4 targeting guide RNA
augcugguuuuucaguuuucag

SEQ ID NO: 6120 - RNA, 22 nt, Artificial Sequence
  CXCR4 targeting guide RNA
auggagagauuaucuaugcaua

SEQ ID NO: 6121 - RNA, 22 nt, Artificial Sequence
  CXCR4 targeting guide RNA
auggcacuuauaaccaaagccc

SEQ ID NO: 6122 - RNA, 22 nt, Artificial Sequence
  CXCR4 targeting guide RNA
augucucgugguaggacuguag

SEQ ID NO: 6123 - RNA, 22 nt, Artificial Sequence
  CXCR4 targeting guide RNA
augugugucuaggcaggaccug

SEQ ID NO: 6124 - RNA, 22 nt, Artificial Sequence
  CXCR4 targeting guide RNA
auguucaguucccuuuucuaca

SEQ ID NO: 6125 - RNA, 22 nt, Artificial Sequence
  CXCR4 targeting guide RNA
auuaucuaugcauaaacagcug

SEQ ID NO: 6126 - RNA, 22 nt, Artificial Sequence
  CXCR4 targeting guide RNA
auucacuacacgcucuggaaug

SEQ ID NO: 6127 - RNA, 22 nt, Artificial Sequence
  CXCR4 targeting guide RNA
auuccagagcguguagugaauc

SEQ ID NO: 6128 - RNA, 22 nt, Artificial Sequence
  CXCR4 targeting guide RNA
auucccguggaacguuuuuccu

SEQ ID NO: 6129 - RNA, 22 nt, Artificial Sequence
  CXCR4 targeting guide RNA
auugaugugugucuaggcagga

SEQ ID NO: 6130 - RNA, 22 nt, Artificial Sequence
  CXCR4 targeting guide RNA
auugcuuguuggauuuuugucu

SEQ ID NO: 6131 - RNA, 22 nt, Artificial Sequence
  CXCR4 targeting guide RNA
auuggucagucuuuuauaucug

SEQ ID NO: 6132 - RNA, 22 nt, Artificial Sequence
  CXCR4 targeting guide RNA
auuucagcaccuacaguguaca

SEQ ID NO: 6133 - RNA, 22 nt, Artificial Sequence
  CXCR4 targeting guide RNA
auuucuagcuuuacgugauuca

SEQ ID NO: 6134 - RNA, 22 nt, Artificial Sequence
  CXCR4 targeting guide RNA
auuucuauaccacuuugggcuu

SEQ ID NO: 6135 - RNA, 22 nt, Artificial Sequence
  CXCR4 targeting guide RNA
auuuugcuguagaagauggcac

SEQ ID NO: 6136 - RNA, 22 nt, Artificial Sequence
  CXCR4 targeting guide RNA
caaaaucacgucuuaagaacag

SEQ ID NO: 6137 - RNA, 22 nt, Artificial Sequence
  CXCR4 targeting guide RNA
caaagcccaaagugguauagaa

SEQ ID NO: 6138 - RNA, 22 nt, Artificial Sequence
  CXCR4 targeting guide RNA
caaagugguauagaaaugcugg

SEQ ID NO: 6139 - RNA, 22 nt, Artificial Sequence
  CXCR4 targeting guide RNA
caacaagcaauaaaaacuguac

SEQ ID NO: 6140 - RNA, 22 nt, Artificial Sequence
  CXCR4 targeting guide RNA
caacccacuccugaaaacugaa

SEQ ID NO: 6141 - RNA, 22 nt, Artificial Sequence
  CXCR4 targeting guide RNA
caacuaagaacuuggccacagg

SEQ ID NO: 6142 - RNA, 22 nt, Artificial Sequence
  CXCR4 targeting guide RNA
caacuuaauacaagacuguaca

SEQ ID NO: 6143 - RNA, 22 nt, Artificial Sequence
  CXCR4 targeting guide RNA
caagacaaaaauccaacaagca

SEQ ID NO: 6144 - RNA, 22 nt, Artificial Sequence
  CXCR4 targeting guide RNA
caagacuguacacuguaggugc

SEQ ID NO: 6145 - RNA, 22 nt, Artificial Sequence
  CXCR4 targeting guide RNA
caaguucuuaguugcuguaugu

SEQ ID NO: 6146 - RNA, 22 nt, Artificial Sequence
  CXCR4 targeting guide RNA
cacaagacaaaaauccaacaag

SEQ ID NO: 6147 - RNA, 22 nt, Artificial Sequence
  CXCR4 targeting guide RNA
cacagguccugccuagacacac

SEQ ID NO: 6148 - RNA, 22 nt, Artificial Sequence
  CXCR4 targeting guide RNA
caccuacaguguacagucuugu

SEQ ID NO: 6149 - RNA, 22 nt, Artificial Sequence
  CXCR4 targeting guide RNA
cacgagacauacagcaacuaag

SEQ ID NO: 6150 - RNA, 22 nt, Artificial Sequence
  CXCR4 targeting guide RNA
cacgcucuggaauguucaguuc

SEQ ID NO: 6151 - RNA, 22 nt, Artificial Sequence
  CXCR4 targeting guide RNA
cacgggaauggagagauuaucu

SEQ ID NO: 6152 - RNA, 22 nt, Artificial Sequence
  CXCR4 targeting guide RNA
cacguaaagcuagaaaugaucc

SEQ ID NO: 6153 - RNA, 22 nt, Artificial Sequence
  CXCR4 targeting guide RNA
cacgucuuaagaacaggaaaaa

SEQ ID NO: 6154 - RNA, 22 nt, Artificial Sequence
  CXCR4 targeting guide RNA
cacuacacgcucuggaauguuc

SEQ ID NO: 6155 - RNA, 22 nt, Artificial Sequence
  CXCR4 targeting guide RNA
cacuccugaaaacugaaaaacc

SEQ ID NO: 6156 - RNA, 22 nt, Artificial Sequence
  CXCR4 targeting guide RNA
cacuguaggugcugaaaucaac

SEQ ID NO: 6157 - RNA, 22 nt, Artificial Sequence
  CXCR4 targeting guide RNA
cacuuauaaccaaagcccaaag

SEQ ID NO: 6158 - RNA, 22 nt, Artificial Sequence
  CXCR4 targeting guide RNA
cacuuugggcuuugguuauaag

SEQ ID NO: 6159 - RNA, 22 nt, Artificial Sequence
  CXCR4 targeting guide RNA
cagagcguguagugaaucacgu

SEQ ID NO: 6160 - RNA, 22 nt, Artificial Sequence
  CXCR4 targeting guide RNA
cagauauaaaagacugaccaau

SEQ ID NO: 6161 - RNA, 22 nt, Artificial Sequence
  CXCR4 targeting guide RNA
cagcaaaaucacgucuuaagaa

SEQ ID NO: 6162 - RNA, 22 nt, Artificial Sequence
  CXCR4 targeting guide RNA
cagcaacuaagaacuuggccac

SEQ ID NO: 6163 - RNA, 22 nt, Artificial Sequence
  CXCR4 targeting guide RNA
cagcaccuacaguguacagucu

SEQ ID NO: 6164 - RNA, 22 nt, Artificial Sequence
  CXCR4 targeting guide RNA
cagcauuucuauaccacuuugg

SEQ ID NO: 6165 - RNA, 22 nt, Artificial Sequence
  CXCR4 targeting guide RNA
cagcuggggaucauuucuagcu

SEQ ID NO: 6166 - RNA, 22 nt, Artificial Sequence
  CXCR4 targeting guide RNA
cagcuguuuaugcauagauaau

SEQ ID NO: 6167 - RNA, 22 nt, Artificial Sequence
  CXCR4 targeting guide RNA
caggaaaaacguuccacgggaa

SEQ ID NO: 6168 - RNA, 22 nt, Artificial Sequence
  CXCR4 targeting guide RNA
caggaccuguggccaaguucuu

SEQ ID NO: 6169 - RNA, 22 nt, Artificial Sequence
  CXCR4 targeting guide RNA
caggaguggguugauuucagca

SEQ ID NO: 6170 - RNA, 22 nt, Artificial Sequence
  CXCR4 targeting guide RNA
cagguccugccuagacacacau

SEQ ID NO: 6171 - RNA, 22 nt, Artificial Sequence
  CXCR4 targeting guide RNA
caguccuaccacgagacauaca

SEQ ID NO: 6172 - RNA, 22 nt, Artificial Sequence
  CXCR4 targeting guide RNA
caguguacagucuuguauuaag

SEQ ID NO: 6173 - RNA, 22 nt, Artificial Sequence
  CXCR4 targeting guide RNA
caguucccuuuucuacaguccu

SEQ ID NO: 6174 - RNA, 22 nt, Artificial Sequence
  CXCR4 targeting guide RNA
caguuuucaggaguggguugau

SEQ ID NO: 6175 - RNA, 22 nt, Artificial Sequence
  CXCR4 targeting guide RNA
caguuuuuauugcuuguuggau

SEQ ID NO: 6176 - RNA, 22 nt, Artificial Sequence
  CXCR4 targeting guide RNA
cauaaacagcuggggaucauuu

SEQ ID NO: 6177 - RNA, 22 nt, Artificial Sequence
  CXCR4 targeting guide RNA
cauacagcaacuaagaacuugg

SEQ ID NO: 6178 - RNA, 22 nt, Artificial Sequence
  CXCR4 targeting guide RNA
cauagauaaucucuccauuccc

SEQ ID NO: 6179 - RNA, 22 nt, Artificial Sequence
  CXCR4 targeting guide RNA
cauauugaugugugucuaggca

SEQ ID NO: 6180 - RNA, 22 nt, Artificial Sequence
  CXCR4 targeting guide RNA
caucuucuacagcaaaaucacg

SEQ ID NO: 6181 - RNA, 22 nt, Artificial Sequence
  CXCR4 targeting guide RNA
cauuccagagcguguagugaau

SEQ ID NO: 6182 - RNA, 22 nt, Artificial Sequence
  CXCR4 targeting guide RNA
cauucccguggaacguuuuucc

SEQ ID NO: 6183 - RNA, 22 nt, Artificial Sequence
  CXCR4 targeting guide RNA
cauuucuagcuuuacgugauuc

SEQ ID NO: 6184 - RNA, 22 nt, Artificial Sequence
  CXCR4 targeting guide RNA
cauuucuauaccacuuugggcu

SEQ ID NO: 6185 - RNA, 22 nt, Artificial Sequence
  CXCR4 targeting guide RNA
ccaaagcccaaagugguauaga

SEQ ID NO: 6186 - RNA, 22 nt, Artificial Sequence
  CXCR4 targeting guide RNA
ccaaagugguauagaaaugcug

SEQ ID NO: 6187 - RNA, 22 nt, Artificial Sequence
  CXCR4 targeting guide RNA
ccaacaagcaauaaaaacugua

SEQ ID NO: 6188 - RNA, 22 nt, Artificial Sequence
  CXCR4 targeting guide RNA
ccaaguucuuaguugcuguaug

SEQ ID NO: 6189 - RNA, 22 nt, Artificial Sequence
  CXCR4 targeting guide RNA
ccacagguccugccuagacaca

SEQ ID NO: 6190 - RNA, 22 nt, Artificial Sequence
  CXCR4 targeting guide RNA
ccacgagacauacagcaacuaa

SEQ ID NO: 6191 - RNA, 22 nt, Artificial Sequence
  CXCR4 targeting guide RNA
ccacgggaauggagagauuauc

SEQ ID NO: 6192 - RNA, 22 nt, Artificial Sequence
  CXCR4 targeting guide RNA
ccacuccugaaaacugaaaaac

SEQ ID NO: 6193 - RNA, 22 nt, Artificial Sequence
  CXCR4 targeting guide RNA
ccacuuugggcuuugguuauaa

SEQ ID NO: 6194 - RNA, 22 nt, Artificial Sequence
  CXCR4 targeting guide RNA
ccagagcguguagugaaucacg

SEQ ID NO: 6195 - RNA, 22 nt, Artificial Sequence
  CXCR4 targeting guide RNA
ccagcauuucuauaccacuuug

SEQ ID NO: 6196 - RNA, 22 nt, Artificial Sequence
  CXCR4 targeting guide RNA
ccagcuguuuaugcauagauaa

SEQ ID NO: 6197 - RNA, 22 nt, Artificial Sequence
  CXCR4 targeting guide RNA
ccaucuucuacagcaaaaucac

SEQ ID NO: 6198 - RNA, 22 nt, Artificial Sequence
  CXCR4 targeting guide RNA
ccauucccguggaacguuuuuc

SEQ ID NO: 6199 - RNA, 22 nt, Artificial Sequence
  CXCR4 targeting guide RNA
cccaaagugguauagaaaugcu

SEQ ID NO: 6200 - RNA, 22 nt, Artificial Sequence
  CXCR4 targeting guide RNA
cccacuccugaaaacugaaaaa

SEQ ID NO: 6201 - RNA, 22 nt, Artificial Sequence
  CXCR4 targeting guide RNA
cccagcuguuuaugcauagaua

SEQ ID NO: 6202 - RNA, 22 nt, Artificial Sequence
  CXCR4 targeting guide RNA
ccccagcuguuuaugcauagau

SEQ ID NO: 6203 - RNA, 22 nt, Artificial Sequence
  CXCR4 targeting guide RNA
cccguggaacguuuuuccuguu

SEQ ID NO: 6204 - RNA, 22 nt, Artificial Sequence
  CXCR4 targeting guide RNA
cccuuuucuacaguccuaccac

SEQ ID NO: 6205 - RNA, 22 nt, Artificial Sequence
  CXCR4 targeting guide RNA
ccguggaacguuuuuccuguuc

SEQ ID NO: 6206 - RNA, 22 nt, Artificial Sequence
  CXCR4 targeting guide RNA
ccuacaguguacagucuuguau

SEQ ID NO: 6207 - RNA, 22 nt, Artificial Sequence
  CXCR4 targeting guide RNA
ccuaccacgagacauacagcaa

SEQ ID NO: 6208 - RNA, 22 nt, Artificial Sequence
  CXCR4 targeting guide RNA
ccuagacacacaucaauaugaa

SEQ ID NO: 6209 - RNA, 22 nt, Artificial Sequence
  CXCR4 targeting guide RNA
ccugaaaacugaaaaaccagca

SEQ ID NO: 6210 - RNA, 22 nt, Artificial Sequence
  CXCR4 targeting guide RNA
ccugccuagacacacaucaaua

SEQ ID NO: 6211 - RNA, 22 nt, Artificial Sequence
  CXCR4 targeting guide RNA
ccuguggccaaguucuuaguug

SEQ ID NO: 6212 - RNA, 22 nt, Artificial Sequence
  CXCR4 targeting guide RNA
ccuguucuuaagacgugauuuu

SEQ ID NO: 6213 - RNA, 22 nt, Artificial Sequence
  CXCR4 targeting guide RNA
ccuuuucuacaguccuaccacg

SEQ ID NO: 6214 - RNA, 22 nt, Artificial Sequence
  CXCR4 targeting guide RNA
cgagacauacagcaacuaagaa

SEQ ID NO: 6215 - RNA, 22 nt, Artificial Sequence
  CXCR4 targeting guide RNA
cgcucuggaauguucaguuccc

SEQ ID NO: 6216 - RNA, 22 nt, Artificial Sequence
  CXCR4 targeting guide RNA
cgggaauggagagauuaucuau

SEQ ID NO: 6217 - RNA, 22 nt, Artificial Sequence
  CXCR4 targeting guide RNA
cguaaagcuagaaaugaucccc

SEQ ID NO: 6218 - RNA, 22 nt, Artificial Sequence
  CXCR4 targeting guide RNA
cgucuuaagaacaggaaaaacg

SEQ ID NO: 6219 - RNA, 22 nt, Artificial Sequence
  CXCR4 targeting guide RNA
cgugauucacuacacgcucugg

SEQ ID NO: 6220 - RNA, 22 nt, Artificial Sequence
  CXCR4 targeting guide RNA
cgugauuuugcuguagaagaug

SEQ ID NO: 6221 - RNA, 22 nt, Artificial Sequence
  CXCR4 targeting guide RNA
cguggaacguuuuuccuguucu

SEQ ID NO: 6222 - RNA, 22 nt, Artificial Sequence
  CXCR4 targeting guide RNA
cgugguaggacuguagaaaagg

SEQ ID NO: 6223 - RNA, 22 nt, Artificial Sequence
  CXCR4 targeting guide RNA
cguguagugaaucacguaaagc

SEQ ID NO: 6224 - RNA, 22 nt, Artificial Sequence
  CXCR4 targeting guide RNA
cguuccacgggaauggagagau

SEQ ID NO: 6225 - RNA, 22 nt, Artificial Sequence
  CXCR4 targeting guide RNA
cguuuuuccuguucuuaagacg

SEQ ID NO: 6226 - RNA, 22 nt, Artificial Sequence
  CXCR4 targeting guide RNA
cuaagaacuuggccacaggucc

SEQ ID NO: 6227 - RNA, 22 nt, Artificial Sequence
  CXCR4 targeting guide RNA
cuacacgcucuggaauguucag

SEQ ID NO: 6228 - RNA, 22 nt, Artificial Sequence
  CXCR4 targeting guide RNA
cuacagcaaaaucacgucuuaa

SEQ ID NO: 6229 - RNA, 22 nt, Artificial Sequence
  CXCR4 targeting guide RNA
cuacaguccuaccacgagacau

SEQ ID NO: 6230 - RNA, 22 nt, Artificial Sequence
  CXCR4 targeting guide RNA
cuacaguguacagucuuguauu

SEQ ID NO: 6231 - RNA, 22 nt, Artificial Sequence
  CXCR4 targeting guide RNA
cuaccacgagacauacagcaac

SEQ ID NO: 6232 - RNA, 22 nt, Artificial Sequence
  CXCR4 targeting guide RNA
cuagaaaugauccccagcuguu

SEQ ID NO: 6233 - RNA, 22 nt, Artificial Sequence
  CXCR4 targeting guide RNA
cuagacacacaucaauaugaaa

SEQ ID NO: 6234 - RNA, 22 nt, Artificial Sequence
  CXCR4 targeting guide RNA
cuagcuuuacgugauucacuac

SEQ ID NO: 6235 - RNA, 22 nt, Artificial Sequence
  CXCR4 targeting guide RNA
cuaggcaggaccuguggccaag

SEQ ID NO: 6236 - RNA, 22 nt, Artificial Sequence
  CXCR4 targeting guide RNA
cuauaccacuuugggcuuuggu

SEQ ID NO: 6237 - RNA, 22 nt, Artificial Sequence
  CXCR4 targeting guide RNA
cuaugcauaaacagcuggggau

SEQ ID NO: 6238 - RNA, 22 nt, Artificial Sequence
  CXCR4 targeting guide RNA
cuccauucccguggaacguuuu

SEQ ID NO: 6239 - RNA, 22 nt, Artificial Sequence
  CXCR4 targeting guide RNA
cuccugaaaacugaaaaaccag

SEQ ID NO: 6240 - RNA, 22 nt, Artificial Sequence
  CXCR4 targeting guide RNA
cucgugguaggacuguagaaaa

SEQ ID NO: 6241 - RNA, 22 nt, Artificial Sequence
  CXCR4 targeting guide RNA
cucuccauucccguggaacguu

SEQ ID NO: 6242 - RNA, 22 nt, Artificial Sequence
  CXCR4 targeting guide RNA
cucuggaauguucaguucccuu

SEQ ID NO: 6243 - RNA, 22 nt, Artificial Sequence
  CXCR4 targeting guide RNA
cugaaaaaccagcauuucuaua

SEQ ID NO: 6244 - RNA, 22 nt, Artificial Sequence
  CXCR4 targeting guide RNA
cugaaaacugaaaaaccagcau

SEQ ID NO: 6245 - RNA, 22 nt, Artificial Sequence
  CXCR4 targeting guide RNA
cugaaaucaacccacuccugaa

SEQ ID NO: 6246 - RNA, 22 nt, Artificial Sequence
  CXCR4 targeting guide RNA
cugaacauuccagagcguguag

SEQ ID NO: 6247 - RNA, 22 nt, Artificial Sequence
  CXCR4 targeting guide RNA
cugaccaauauuguacaguuuu

SEQ ID NO: 6248 - RNA, 22 nt, Artificial Sequence
  CXCR4 targeting guide RNA
cugccuagacacacaucaauau

SEQ ID NO: 6249 - RNA, 22 nt, Artificial Sequence
  CXCR4 targeting guide RNA
cuggaauguucaguucccuuuu

SEQ ID NO: 6250 - RNA, 22 nt, Artificial Sequence
  CXCR4 targeting guide RNA
cuggggaucauuucuagcuuua

SEQ ID NO: 6251 - RNA, 22 nt, Artificial Sequence
  CXCR4 targeting guide RNA
cugguuuuucaguuuucaggag

SEQ ID NO: 6252 - RNA, 22 nt, Artificial Sequence
  CXCR4 targeting guide RNA
cuguacaauauuggucagucuu

SEQ ID NO: 6253 - RNA, 22 nt, Artificial Sequence
  CXCR4 targeting guide RNA
cuguacacuguaggugcugaaa

SEQ ID NO: 6254 - RNA, 22 nt, Artificial Sequence
  CXCR4 targeting guide RNA
cuguagaaaagggaacugaaca

SEQ ID NO: 6255 - RNA, 22 nt, Artificial Sequence
  CXCR4 targeting guide RNA
cuguagaagauggcacuuauaa

SEQ ID NO: 6256 - RNA, 22 nt, Artificial Sequence
  CXCR4 targeting guide RNA
cuguaggugcugaaaucaaccc

SEQ ID NO: 6257 - RNA, 22 nt, Artificial Sequence
  CXCR4 targeting guide RNA
cuguaugucucgugguaggacu

SEQ ID NO: 6258 - RNA, 22 nt, Artificial Sequence
  CXCR4 targeting guide RNA
cuguggccaaguucuuaguugc

SEQ ID NO: 6259 - RNA, 22 nt, Artificial Sequence
  CXCR4 targeting guide RNA
cuguucuuaagacgugauuuug

SEQ ID NO: 6260 - RNA, 22 nt, Artificial Sequence
  CXCR4 targeting guide RNA
cuguuuaugcauagauaaucuc

SEQ ID NO: 6261 - RNA, 22 nt, Artificial Sequence
  CXCR4 targeting guide RNA
cuuaagaacaggaaaaacguuc

SEQ ID NO: 6262 - RNA, 22 nt, Artificial Sequence
  CXCR4 targeting guide RNA
cuuaagacgugauuuugcugua

SEQ ID NO: 6263 - RNA, 22 nt, Artificial Sequence
  CXCR4 targeting guide RNA
cuuaauacaagacuguacacug

SEQ ID NO: 6264 - RNA, 22 nt, Artificial Sequence
  CXCR4 targeting guide RNA
cuuaguugcuguaugucucgug

SEQ ID NO: 6265 - RNA, 22 nt, Artificial Sequence
  CXCR4 targeting guide RNA
cuuauaaccaaagcccaaagug

SEQ ID NO: 6266 - RNA, 22 nt, Artificial Sequence
  CXCR4 targeting guide RNA
cuucuacagcaaaaucacgucu

SEQ ID NO: 6267 - RNA, 22 nt, Artificial Sequence
  CXCR4 targeting guide RNA
cuuggccacagguccugccuag

SEQ ID NO: 6268 - RNA, 22 nt, Artificial Sequence
  CXCR4 targeting guide RNA
cuuguuggauuuuugucuugug

SEQ ID NO: 6269 - RNA, 22 nt, Artificial Sequence
  CXCR4 targeting guide RNA
cuuuacgugauucacuacacgc

SEQ ID NO: 6270 - RNA, 22 nt, Artificial Sequence
  CXCR4 targeting guide RNA
cuuugggcuuugguuauaagug

SEQ ID NO: 6271 - RNA, 22 nt, Artificial Sequence
  CXCR4 targeting guide RNA
cuuugguuauaagugccaucuu

SEQ ID NO: 6272 - RNA, 22 nt, Artificial Sequence
  CXCR4 targeting guide RNA
cuuuucuacaguccuaccacga

SEQ ID NO: 6273 - RNA, 22 nt, Artificial Sequence
  CXCR4 targeting guide RNA
gaaaaaccagcauuucuauacc

SEQ ID NO: 6274 - RNA, 22 nt, Artificial Sequence
  CXCR4 targeting guide RNA
gaaaaacguuccacgggaaugg

SEQ ID NO: 6275 - RNA, 22 nt, Artificial Sequence
  CXCR4 targeting guide RNA
gaaaacugaaaaaccagcauuu

SEQ ID NO: 6276 - RNA, 22 nt, Artificial Sequence
  CXCR4 targeting guide RNA
gaaaagggaacugaacauucca

SEQ ID NO: 6277 - RNA, 22 nt, Artificial Sequence
  CXCR4 targeting guide RNA
gaaacacaagacaaaaauccaa

SEQ ID NO: 6278 - RNA, 22 nt, Artificial Sequence
  CXCR4 targeting guide RNA
gaaaucaacccacuccugaaaa

SEQ ID NO: 6279 - RNA, 22 nt, Artificial Sequence
  CXCR4 targeting guide RNA
gaaaugauccccagcuguuuau

SEQ ID NO: 6280 - RNA, 22 nt, Artificial Sequence
  CXCR4 targeting guide RNA
gaaaugcugguuuuucaguuuu

SEQ ID NO: 6281 - RNA, 22 nt, Artificial Sequence
  CXCR4 targeting guide RNA
gaacaggaaaaacguuccacgg

SEQ ID NO: 6282 - RNA, 22 nt, Artificial Sequence
  CXCR4 targeting guide RNA
gaacauuccagagcguguagug

SEQ ID NO: 6283 - RNA, 22 nt, Artificial Sequence
  CXCR4 targeting guide RNA
gaacguuuuuccuguucuuaag

SEQ ID NO: 6284 - RNA, 22 nt, Artificial Sequence
  CXCR4 targeting guide RNA
gaacugaacauuccagagcgug

SEQ ID NO: 6285 - RNA, 22 nt, Artificial Sequence
  CXCR4 targeting guide RNA
gaacuuggccacagguccugcc

SEQ ID NO: 6286 - RNA, 22 nt, Artificial Sequence
  CXCR4 targeting guide RNA
gaagauggcacuuauaaccaaa

SEQ ID NO: 6287 - RNA, 22 nt, Artificial Sequence
  CXCR4 targeting guide RNA
gaaucacguaaagcuagaaaug

SEQ ID NO: 6288 - RNA, 22 nt, Artificial Sequence
  CXCR4 targeting guide RNA
gaauggagagauuaucuaugca

SEQ ID NO: 6289 - RNA, 22 nt, Artificial Sequence
  CXCR4 targeting guide RNA
gaauguucaguucccuuuucua

SEQ ID NO: 6290 - RNA, 22 nt, Artificial Sequence
  CXCR4 targeting guide RNA
gacaaaaauccaacaagcaaua

SEQ ID NO: 6291 - RNA, 22 nt, Artificial Sequence
  CXCR4 targeting guide RNA
gacacacaucaauaugaaacaa

SEQ ID NO: 6292 - RNA, 22 nt, Artificial Sequence
  CXCR4 targeting guide RNA
gacauacagcaacuaagaacuu

SEQ ID NO: 6293 - RNA, 22 nt, Artificial Sequence
  CXCR4 targeting guide RNA
gaccuguggccaaguucuuagu

SEQ ID NO: 6294 - RNA, 22 nt, Artificial Sequence
  CXCR4 targeting guide RNA
gacgugauuuugcuguagaaga

SEQ ID NO: 6295 - RNA, 22 nt, Artificial Sequence
  CXCR4 targeting guide RNA
gacugaccaauauuguacaguu

SEQ ID NO: 6296 - RNA, 22 nt, Artificial Sequence
  CXCR4 targeting guide RNA
gacuguacacuguaggugcuga

SEQ ID NO: 6297 - RNA, 22 nt, Artificial Sequence
  CXCR4 targeting guide RNA
gacuguagaaaagggaacugaa

SEQ ID NO: 6298 - RNA, 22 nt, Artificial Sequence
  CXCR4 targeting guide RNA
gagacauacagcaacuaagaac

SEQ ID NO: 6299 - RNA, 22 nt, Artificial Sequence
  CXCR4 targeting guide RNA
gagagauuaucuaugcauaaac

SEQ ID NO: 6300 - RNA, 22 nt, Artificial Sequence
  CXCR4 targeting guide RNA
gagauuaucuaugcauaaacag

SEQ ID NO: 6301 - RNA, 22 nt, Artificial Sequence
  CXCR4 targeting guide RNA
gagcguguagugaaucacguaa

SEQ ID NO: 6302 - RNA, 22 nt, Artificial Sequence
  CXCR4 targeting guide RNA
gaguggguugauuucagcaccu

SEQ ID NO: 6303 - RNA, 22 nt, Artificial Sequence
  CXCR4 targeting guide RNA
gauaaucucuccauucccgugg

SEQ ID NO: 6304 - RNA, 22 nt, Artificial Sequence
  CXCR4 targeting guide RNA
gaucauuucuagcuuuacguga

SEQ ID NO: 6305 - RNA, 22 nt, Artificial Sequence
  CXCR4 targeting guide RNA
gauccccagcuguuuaugcaua

SEQ ID NO: 6306 - RNA, 22 nt, Artificial Sequence
  CXCR4 targeting guide RNA
gauggcacuuauaaccaaagcc

SEQ ID NO: 6307 - RNA, 22 nt, Artificial Sequence
  CXCR4 targeting guide RNA
gaugugugucuaggcaggaccu

SEQ ID NO: 6308 - RNA, 22 nt, Artificial Sequence
  CXCR4 targeting guide RNA
gauuaucuaugcauaaacagcu

SEQ ID NO: 6309 - RNA, 22 nt, Artificial Sequence
  CXCR4 targeting guide RNA
gauucacuacacgcucuggaau

SEQ ID NO: 6310 - RNA, 22 nt, Artificial Sequence
  CXCR4 targeting guide RNA
gauuucagcaccuacaguguac

SEQ ID NO: 6311 - RNA, 22 nt, Artificial Sequence
  CXCR4 targeting guide RNA
gauuuugcuguagaagauggca

SEQ ID NO: 6312 - RNA, 22 nt, Artificial Sequence
  CXCR4 targeting guide RNA
gcaaaaucacgucuuaagaaca

SEQ ID NO: 6313 - RNA, 22 nt, Artificial Sequence
  CXCR4 targeting guide RNA
gcaacuaagaacuuggccacag

SEQ ID NO: 6314 - RNA, 22 nt, Artificial Sequence
  CXCR4 targeting guide RNA
gcaccuacaguguacagucuug

SEQ ID NO: 6315 - RNA, 22 nt, Artificial Sequence
  CXCR4 targeting guide RNA
gcacuuauaaccaaagcccaaa

SEQ ID NO: 6316 - RNA, 22 nt, Artificial Sequence
  CXCR4 targeting guide RNA
gcaggaccuguggccaaguucu

SEQ ID NO: 6317 - RNA, 22 nt, Artificial Sequence
  CXCR4 targeting guide RNA
gcauaaacagcuggggaucauu

SEQ ID NO: 6318 - RNA, 22 nt, Artificial Sequence
  CXCR4 targeting guide RNA
gcauagauaaucucuccauucc

SEQ ID NO: 6319 - RNA, 22 nt, Artificial Sequence
  CXCR4 targeting guide RNA
gcauuucuauaccacuuugggc

SEQ ID NO: 6320 - RNA, 22 nt, Artificial Sequence
  CXCR4 targeting guide RNA
gccaaguucuuaguugcuguau

SEQ ID NO: 6321 - RNA, 22 nt, Artificial Sequence
  CXCR4 targeting guide RNA
gccacagguccugccuagacac

SEQ ID NO: 6322 - RNA, 22 nt, Artificial Sequence
  CXCR4 targeting guide RNA
gccaucuucuacagcaaaauca

SEQ ID NO: 6323 - RNA, 22 nt, Artificial Sequence
  CXCR4 targeting guide RNA
gcccaaagugguauagaaaugc

SEQ ID NO: 6324 - RNA, 22 nt, Artificial Sequence
  CXCR4 targeting guide RNA
gccuagacacacaucaauauga

SEQ ID NO: 6325 - RNA, 22 nt, Artificial Sequence
  CXCR4 targeting guide RNA
gcguguagugaaucacguaaag

SEQ ID NO: 6326 - RNA, 22 nt, Artificial Sequence
  CXCR4 targeting guide RNA
gcuagaaaugauccccagcugu

SEQ ID NO: 6327 - RNA, 22 nt, Artificial Sequence
  CXCR4 targeting guide RNA
gcucuggaauguucaguucccu

SEQ ID NO: 6328 - RNA, 22 nt, Artificial Sequence
  CXCR4 targeting guide RNA
gcugaaaucaacccacuccuga

SEQ ID NO: 6329 - RNA, 22 nt, Artificial Sequence
  CXCR4 targeting guide RNA
gcuggggaucauuucuagcuuu

SEQ ID NO: 6330 - RNA, 22 nt, Artificial Sequence
  CXCR4 targeting guide RNA
gcugguuuuucaguuuucagga

SEQ ID NO: 6331 - RNA, 22 nt, Artificial Sequence
  CXCR4 targeting guide RNA
gcuguagaagauggcacuuaua

SEQ ID NO: 6332 - RNA, 22 nt, Artificial Sequence
  CXCR4 targeting guide RNA
gcuguaugucucgugguaggac

SEQ ID NO: 6333 - RNA, 22 nt, Artificial Sequence
  CXCR4 targeting guide RNA
gcuguuuaugcauagauaaucu

SEQ ID NO: 6334 - RNA, 22 nt, Artificial Sequence
  CXCR4 targeting guide RNA
gcuuguuggauuuuugucuugu

SEQ ID NO: 6335 - RNA, 22 nt, Artificial Sequence
  CXCR4 targeting guide RNA
gcuuuacgugauucacuacacg

SEQ ID NO: 6336 - RNA, 22 nt, Artificial Sequence
  CXCR4 targeting guide RNA
gcuuugguuauaagugccaucu

SEQ ID NO: 6337 - RNA, 22 nt, Artificial Sequence
  CXCR4 targeting guide RNA
ggaaaaacguuccacgggaaug

SEQ ID NO: 6338 - RNA, 22 nt, Artificial Sequence
  CXCR4 targeting guide RNA
ggaacguuuuuccuguucuuaa

SEQ ID NO: 6339 - RNA, 22 nt, Artificial Sequence
  CXCR4 targeting guide RNA
ggaacugaacauuccagagcgu

SEQ ID NO: 6340 - RNA, 22 nt, Artificial Sequence
  CXCR4 targeting guide RNA
ggaauggagagauuaucuaugc

SEQ ID NO: 6341 - RNA, 22 nt, Artificial Sequence
  CXCR4 targeting guide RNA
ggaauguucaguucccuuuucu

SEQ ID NO: 6342 - RNA, 22 nt, Artificial Sequence
  CXCR4 targeting guide RNA
ggaccuguggccaaguucuuag

SEQ ID NO: 6343 - RNA, 22 nt, Artificial Sequence
  CXCR4 targeting guide RNA
ggacuguagaaaagggaacuga

SEQ ID NO: 6344 - RNA, 22 nt, Artificial Sequence
  CXCR4 targeting guide RNA
ggagagauuaucuaugcauaaa

SEQ ID NO: 6345 - RNA, 22 nt, Artificial Sequence
  CXCR4 targeting guide RNA
ggaguggguugauuucagcacc

SEQ ID NO: 6346 - RNA, 22 nt, Artificial Sequence
  CXCR4 targeting guide RNA
ggaucauuucuagcuuuacgug

SEQ ID NO: 6347 - RNA, 22 nt, Artificial Sequence
  CXCR4 targeting guide RNA
ggauuuuugucuuguguuucuu

SEQ ID NO: 6348 - RNA, 22 nt, Artificial Sequence
  CXCR4 targeting guide RNA
ggcacuuauaaccaaagcccaa

SEQ ID NO: 6349 - RNA, 22 nt, Artificial Sequence
  CXCR4 targeting guide RNA
ggcaggaccuguggccaaguuc

SEQ ID NO: 6350 - RNA, 22 nt, Artificial Sequence
  CXCR4 targeting guide RNA
ggccaaguucuuaguugcugua

SEQ ID NO: 6351 - RNA, 22 nt, Artificial Sequence
  CXCR4 targeting guide RNA
ggccacagguccugccuagaca

SEQ ID NO: 6352 - RNA, 22 nt, Artificial Sequence
  CXCR4 targeting guide RNA
ggcuuugguuauaagugccauc

SEQ ID NO: 6353 - RNA, 22 nt, Artificial Sequence
  CXCR4 targeting guide RNA
gggaacugaacauuccagagcg

SEQ ID NO: 6354 - RNA, 22 nt, Artificial Sequence
  CXCR4 targeting guide RNA
gggaauggagagauuaucuaug

SEQ ID NO: 6355 - RNA, 22 nt, Artificial Sequence
  CXCR4 targeting guide RNA
gggaucauuucuagcuuuacgu

SEQ ID NO: 6356 - RNA, 22 nt, Artificial Sequence
  CXCR4 targeting guide RNA
gggcuuugguuauaagugccau

SEQ ID NO: 6357 - RNA, 22 nt, Artificial Sequence
  CXCR4 targeting guide RNA
ggggaucauuucuagcuuuacg

SEQ ID NO: 6358 - RNA, 22 nt, Artificial Sequence
  CXCR4 targeting guide RNA
ggguugauuucagcaccuacag

SEQ ID NO: 6359 - RNA, 22 nt, Artificial Sequence
  CXCR4 targeting guide RNA
gguaggacuguagaaaagggaa

SEQ ID NO: 6360 - RNA, 22 nt, Artificial Sequence
  CXCR4 targeting guide RNA
gguauagaaaugcugguuuuuc

SEQ ID NO: 6361 - RNA, 22 nt, Artificial Sequence
  CXCR4 targeting guide RNA
ggucagucuuuuauaucugaaa

SEQ ID NO: 6362 - RNA, 22 nt, Artificial Sequence
  CXCR4 targeting guide RNA
gguccugccuagacacacauca

SEQ ID NO: 6363 - RNA, 22 nt, Artificial Sequence
  CXCR4 targeting guide RNA
ggugcugaaaucaacccacucc

SEQ ID NO: 6364 - RNA, 22 nt, Artificial Sequence
  CXCR4 targeting guide RNA
gguuauaagugccaucuucuac

SEQ ID NO: 6365 - RNA, 22 nt, Artificial Sequence
  CXCR4 targeting guide RNA
gguugauuucagcaccuacagu

SEQ ID NO: 6366 - RNA, 22 nt, Artificial Sequence
  CXCR4 targeting guide RNA
gguuuuucaguuuucaggagug

SEQ ID NO: 6367 - RNA, 22 nt, Artificial Sequence
  CXCR4 targeting guide RNA
guaaagcuagaaaugaucccca

SEQ ID NO: 6368 - RNA, 22 nt, Artificial Sequence
  CXCR4 targeting guide RNA
guacaauauuggucagucuuuu

SEQ ID NO: 6369 - RNA, 22 nt, Artificial Sequence
  CXCR4 targeting guide RNA
guacacuguaggugcugaaauc

SEQ ID NO: 6370 - RNA, 22 nt, Artificial Sequence
  CXCR4 targeting guide RNA
guacagucuuguauuaaguugu

SEQ ID NO: 6371 - RNA, 22 nt, Artificial Sequence
  CXCR4 targeting guide RNA
guacaguuuuuauugcuuguug

SEQ ID NO: 6372 - RNA, 22 nt, Artificial Sequence
  CXCR4 targeting guide RNA
guagaaaagggaacugaacauu

SEQ ID NO: 6373 - RNA, 22 nt, Artificial Sequence
  CXCR4 targeting guide RNA
guagaagauggcacuuauaacc

SEQ ID NO: 6374 - RNA, 22 nt, Artificial Sequence
  CXCR4 targeting guide RNA
guaggacuguagaaaagggaac

SEQ ID NO: 6375 - RNA, 22 nt, Artificial Sequence
  CXCR4 targeting guide RNA
guaggugcugaaaucaacccac

SEQ ID NO: 6376 - RNA, 22 nt, Artificial Sequence
  CXCR4 targeting guide RNA
guagugaaucacguaaagcuag

SEQ ID NO: 6377 - RNA, 22 nt, Artificial Sequence
  CXCR4 targeting guide RNA
guauagaaaugcugguuuuuca

SEQ ID NO: 6378 - RNA, 22 nt, Artificial Sequence
  CXCR4 targeting guide RNA
guaugucucgugguaggacugu

SEQ ID NO: 6379 - RNA, 22 nt, Artificial Sequence
  CXCR4 targeting guide RNA
guccuaccacgagacauacagc

SEQ ID NO: 6380 - RNA, 22 nt, Artificial Sequence
  CXCR4 targeting guide RNA
guccugccuagacacacaucaa

SEQ ID NO: 6381 - RNA, 22 nt, Artificial Sequence
  CXCR4 targeting guide RNA
gucuaggcaggaccuguggcca

SEQ ID NO: 6382 - RNA, 22 nt, Artificial Sequence
  CXCR4 targeting guide RNA
gucucgugguaggacuguagaa

SEQ ID NO: 6383 - RNA, 22 nt, Artificial Sequence
  CXCR4 targeting guide RNA
gucuuaagaacaggaaaaacgu

SEQ ID NO: 6384 - RNA, 22 nt, Artificial Sequence
  CXCR4 targeting guide RNA
gugaaucacguaaagcuagaaa

SEQ ID NO: 6385 - RNA, 22 nt, Artificial Sequence
  CXCR4 targeting guide RNA
gugauucacuacacgcucugga

SEQ ID NO: 6386 - RNA, 22 nt, Artificial Sequence
  CXCR4 targeting guide RNA
gugauuuugcuguagaagaugg

SEQ ID NO: 6387 - RNA, 22 nt, Artificial Sequence
  CXCR4 targeting guide RNA
gugccaucuucuacagcaaaau

SEQ ID NO: 6388 - RNA, 22 nt, Artificial Sequence
  CXCR4 targeting guide RNA
gugcugaaaucaacccacuccu

SEQ ID NO: 6389 - RNA, 22 nt, Artificial Sequence
  CXCR4 targeting guide RNA
guggaacguuuuuccuguucuu

SEQ ID NO: 6390 - RNA, 22 nt, Artificial Sequence
  CXCR4 targeting guide RNA
guggccaaguucuuaguugcug

SEQ ID NO: 6391 - RNA, 22 nt, Artificial Sequence
  CXCR4 targeting guide RNA
guggguugauuucagcaccuac

SEQ ID NO: 6392 - RNA, 22 nt, Artificial Sequence
  CXCR4 targeting guide RNA
gugguaggacuguagaaaaggg

SEQ ID NO: 6393 - RNA, 22 nt, Artificial Sequence
  CXCR4 targeting guide RNA
gugguauagaaaugcugguuuu

SEQ ID NO: 6394 - RNA, 22 nt, Artificial Sequence
  CXCR4 targeting guide RNA
guguacagucuuguauuaaguu

SEQ ID NO: 6395 - RNA, 22 nt, Artificial Sequence
  CXCR4 targeting guide RNA
guguagugaaucacguaaagcu

SEQ ID NO: 6396 - RNA, 22 nt, Artificial Sequence
  CXCR4 targeting guide RNA
gugucuaggcaggaccuguggc

SEQ ID NO: 6397 - RNA, 22 nt, Artificial Sequence
  CXCR4 targeting guide RNA
gugugucuaggcaggaccugug

SEQ ID NO: 6398 - RNA, 22 nt, Artificial Sequence
  CXCR4 targeting guide RNA
guuauaagugccaucuucuaca

SEQ ID NO: 6399 - RNA, 22 nt, Artificial Sequence
  CXCR4 targeting guide RNA
guucaguucccuuuucuacagu

SEQ ID NO: 6400 - RNA, 22 nt, Artificial Sequence
  CXCR4 targeting guide RNA
guuccacgggaauggagagauu

SEQ ID NO: 6401 - RNA, 22 nt, Artificial Sequence
  CXCR4 targeting guide RNA
guucccuuuucuacaguccuac

SEQ ID NO: 6402 - RNA, 22 nt, Artificial Sequence
  CXCR4 targeting guide RNA
guucuuaagacgugauuuugcu

SEQ ID NO: 6403 - RNA, 22 nt, Artificial Sequence
  CXCR4 targeting guide RNA
guucuuaguugcuguaugucuc

SEQ ID NO: 6404 - RNA, 22 nt, Artificial Sequence
  CXCR4 targeting guide RNA
guugauuucagcaccuacagug

SEQ ID NO: 6405 - RNA, 22 nt, Artificial Sequence
  CXCR4 targeting guide RNA
guugcuguaugucucgugguag

SEQ ID NO: 6406 - RNA, 22 nt, Artificial Sequence
  CXCR4 targeting guide RNA
guuggauuuuugucuuguguuu

SEQ ID NO: 6407 - RNA, 22 nt, Artificial Sequence
  CXCR4 targeting guide RNA
guuuaugcauagauaaucucuc

SEQ ID NO: 6408 - RNA, 22 nt, Artificial Sequence
  CXCR4 targeting guide RNA
guuucauauugaugugugucua

SEQ ID NO: 6409 - RNA, 22 nt, Artificial Sequence
  CXCR4 targeting guide RNA
guuuucaggaguggguugauuu

SEQ ID NO: 6410 - RNA, 22 nt, Artificial Sequence
  CXCR4 targeting guide RNA
guuuuucaguuuucaggagugg

SEQ ID NO: 6411 - RNA, 22 nt, Artificial Sequence
  CXCR4 targeting guide RNA
guuuuuccuguucuuaagacgu

SEQ ID NO: 6412 - RNA, 22 nt, Artificial Sequence
  CXCR4 targeting guide RNA
uaaacagcuggggaucauuucu

SEQ ID NO: 6413 - RNA, 22 nt, Artificial Sequence
  CXCR4 targeting guide RNA
uaaagcuagaaaugauccccag

SEQ ID NO: 6414 - RNA, 22 nt, Artificial Sequence
  CXCR4 targeting guide RNA
uaaccaaagcccaaagugguau

SEQ ID NO: 6415 - RNA, 22 nt, Artificial Sequence
  CXCR4 targeting guide RNA
uaagaacaggaaaaacguucca

SEQ ID NO: 6416 - RNA, 22 nt, Artificial Sequence
  CXCR4 targeting guide RNA
uaagaacuuggccacagguccu

SEQ ID NO: 6417 - RNA, 22 nt, Artificial Sequence
  CXCR4 targeting guide RNA
uaagacgugauuuugcuguaga

SEQ ID NO: 6418 - RNA, 22 nt, Artificial Sequence
  CXCR4 targeting guide RNA
uaagugccaucuucuacagcaa

SEQ ID NO: 6419 - RNA, 22 nt, Artificial Sequence
  CXCR4 targeting guide RNA
uaauacaagacuguacacugua

SEQ ID NO: 6420 - RNA, 22 nt, Artificial Sequence
  CXCR4 targeting guide RNA
uaaucucuccauucccguggaa

SEQ ID NO: 6421 - RNA, 22 nt, Artificial Sequence
  CXCR4 targeting guide RNA
uacaagacuguacacuguaggu

SEQ ID NO: 6422 - RNA, 22 nt, Artificial Sequence
  CXCR4 targeting guide RNA
uacacgcucuggaauguucagu

SEQ ID NO: 6423 - RNA, 22 nt, Artificial Sequence
  CXCR4 targeting guide RNA
uacacuguaggugcugaaauca

SEQ ID NO: 6424 - RNA, 22 nt, Artificial Sequence
  CXCR4 targeting guide RNA
uacagcaaaaucacgucuuaag

SEQ ID NO: 6425 - RNA, 22 nt, Artificial Sequence
  CXCR4 targeting guide RNA
uacagcaacuaagaacuuggcc

SEQ ID NO: 6426 - RNA, 22 nt, Artificial Sequence
  CXCR4 targeting guide RNA
uacaguccuaccacgagacaua

SEQ ID NO: 6427 - RNA, 22 nt, Artificial Sequence
  CXCR4 targeting guide RNA
uacaguguacagucuuguauua

SEQ ID NO: 6428 - RNA, 22 nt, Artificial Sequence
  CXCR4 targeting guide RNA
uacaguuuuuauugcuuguugg

SEQ ID NO: 6429 - RNA, 22 nt, Artificial Sequence
  CXCR4 targeting guide RNA
uaccacgagacauacagcaacu

SEQ ID NO: 6430 - RNA, 22 nt, Artificial Sequence
  CXCR4 targeting guide RNA
uaccacuuugggcuuugguuau

SEQ ID NO: 6431 - RNA, 22 nt, Artificial Sequence
  CXCR4 targeting guide RNA
uacgugauucacuacacgcucu

SEQ ID NO: 6432 - RNA, 22 nt, Artificial Sequence
  CXCR4 targeting guide RNA
uagaaaagggaacugaacauuc

SEQ ID NO: 6433 - RNA, 22 nt, Artificial Sequence
  CXCR4 targeting guide RNA
uagaaaugauccccagcuguuu

SEQ ID NO: 6434 - RNA, 22 nt, Artificial Sequence
  CXCR4 targeting guide RNA
uagaaaugcugguuuuucaguu

SEQ ID NO: 6435 - RNA, 22 nt, Artificial Sequence
  CXCR4 targeting guide RNA
uagaagauggcacuuauaacca

SEQ ID NO: 6436 - RNA, 22 nt, Artificial Sequence
  CXCR4 targeting guide RNA
uagacacacaucaauaugaaac

SEQ ID NO: 6437 - RNA, 22 nt, Artificial Sequence
  CXCR4 targeting guide RNA
uagauaaucucuccauucccgu

SEQ ID NO: 6438 - RNA, 22 nt, Artificial Sequence
  CXCR4 targeting guide RNA
uagcuuuacgugauucacuaca

SEQ ID NO: 6439 - RNA, 22 nt, Artificial Sequence
  CXCR4 targeting guide RNA
uaggacuguagaaaagggaacu

SEQ ID NO: 6440 - RNA, 22 nt, Artificial Sequence
  CXCR4 targeting guide RNA
uaggcaggaccuguggccaagu

SEQ ID NO: 6441 - RNA, 22 nt, Artificial Sequence
  CXCR4 targeting guide RNA
uaggugcugaaaucaacccacu

SEQ ID NO: 6442 - RNA, 22 nt, Artificial Sequence
  CXCR4 targeting guide RNA
uagugaaucacguaaagcuaga

SEQ ID NO: 6443 - RNA, 22 nt, Artificial Sequence
  CXCR4 targeting guide RNA
uaguugcuguaugucucguggu

SEQ ID NO: 6444 - RNA, 22 nt, Artificial Sequence
  CXCR4 targeting guide RNA
uauaaccaaagcccaaaguggu

SEQ ID NO: 6445 - RNA, 22 nt, Artificial Sequence
  CXCR4 targeting guide RNA
uauaagugccaucuucuacagc

SEQ ID NO: 6446 - RNA, 22 nt, Artificial Sequence
  CXCR4 targeting guide RNA
uauaccacuuugggcuuugguu

SEQ ID NO: 6447 - RNA, 22 nt, Artificial Sequence
  CXCR4 targeting guide RNA
uauagaaaugcugguuuuucag

SEQ ID NO: 6448 - RNA, 22 nt, Artificial Sequence
  CXCR4 targeting guide RNA
uaucuaugcauaaacagcuggg

SEQ ID NO: 6449 - RNA, 22 nt, Artificial Sequence
  CXCR4 targeting guide RNA
uaugcauaaacagcuggggauc

SEQ ID NO: 6450 - RNA, 22 nt, Artificial Sequence
  CXCR4 targeting guide RNA
uaugcauagauaaucucuccau

SEQ ID NO: 6451 - RNA, 22 nt, Artificial Sequence
  CXCR4 targeting guide RNA
uaugucucgugguaggacugua

SEQ ID NO: 6452 - RNA, 22 nt, Artificial Sequence
  CXCR4 targeting guide RNA
uauugaugugugucuaggcagg

SEQ ID NO: 6453 - RNA, 22 nt, Artificial Sequence
  CXCR4 targeting guide RNA
uauugcuuguuggauuuuuguc

SEQ ID NO: 6454 - RNA, 22 nt, Artificial Sequence
  CXCR4 targeting guide RNA
ucaacccacuccugaaaacuga

SEQ ID NO: 6455 - RNA, 22 nt, Artificial Sequence
  CXCR4 targeting guide RNA
ucacguaaagcuagaaaugauc

SEQ ID NO: 6456 - RNA, 22 nt, Artificial Sequence
  CXCR4 targeting guide RNA
ucacgucuuaagaacaggaaaa

SEQ ID NO: 6457 - RNA, 22 nt, Artificial Sequence
  CXCR4 targeting guide RNA
ucacuacacgcucuggaauguu

SEQ ID NO: 6458 - RNA, 22 nt, Artificial Sequence
  CXCR4 targeting guide RNA
ucagauauaaaagacugaccaa

SEQ ID NO: 6459 - RNA, 22 nt, Artificial Sequence
  CXCR4 targeting guide RNA
ucagcaccuacaguguacaguc

SEQ ID NO: 6460 - RNA, 22 nt, Artificial Sequence
  CXCR4 targeting guide RNA
ucaggaguggguugauuucagc

SEQ ID NO: 6461 - RNA, 22 nt, Artificial Sequence
  CXCR4 targeting guide RNA
ucaguucccuuuucuacagucc

SEQ ID NO: 6462 - RNA, 22 nt, Artificial Sequence
  CXCR4 targeting guide RNA
ucaguuuucaggaguggguuga

SEQ ID NO: 6463 - RNA, 22 nt, Artificial Sequence
  CXCR4 targeting guide RNA
ucauauugaugugugucuaggc

SEQ ID NO: 6464 - RNA, 22 nt, Artificial Sequence
  CXCR4 targeting guide RNA
ucauuucuagcuuuacgugauu

SEQ ID NO: 6465 - RNA, 22 nt, Artificial Sequence
  CXCR4 targeting guide RNA
uccaacaagcaauaaaaacugu

SEQ ID NO: 6466 - RNA, 22 nt, Artificial Sequence
  CXCR4 targeting guide RNA
uccacgggaauggagagauuau

SEQ ID NO: 6467 - RNA, 22 nt, Artificial Sequence
  CXCR4 targeting guide RNA
uccagagcguguagugaaucac

SEQ ID NO: 6468 - RNA, 22 nt, Artificial Sequence
  CXCR4 targeting guide RNA
uccauucccguggaacguuuuu

SEQ ID NO: 6469 - RNA, 22 nt, Artificial Sequence
  CXCR4 targeting guide RNA
uccccagcuguuuaugcauaga

SEQ ID NO: 6470 - RNA, 22 nt, Artificial Sequence
  CXCR4 targeting guide RNA
ucccguggaacguuuuuccugu

SEQ ID NO: 6471 - RNA, 22 nt, Artificial Sequence
  CXCR4 targeting guide RNA
ucccuuuucuacaguccuacca

SEQ ID NO: 6472 - RNA, 22 nt, Artificial Sequence
  CXCR4 targeting guide RNA
uccuaccacgagacauacagca

SEQ ID NO: 6473 - RNA, 22 nt, Artificial Sequence
  CXCR4 targeting guide RNA
uccugaaaacugaaaaaccagc

SEQ ID NO: 6474 - RNA, 22 nt, Artificial Sequence
  CXCR4 targeting guide RNA
uccugccuagacacacaucaau

SEQ ID NO: 6475 - RNA, 22 nt, Artificial Sequence
  CXCR4 targeting guide RNA
uccuguucuuaagacgugauuu

SEQ ID NO: 6476 - RNA, 22 nt, Artificial Sequence
  CXCR4 targeting guide RNA
ucgugguaggacuguagaaaag

SEQ ID NO: 6477 - RNA, 22 nt, Artificial Sequence
  CXCR4 targeting guide RNA
ucuacagcaaaaucacgucuua

SEQ ID NO: 6478 - RNA, 22 nt, Artificial Sequence
  CXCR4 targeting guide RNA
ucuacaguccuaccacgagaca

SEQ ID NO: 6479 - RNA, 22 nt, Artificial Sequence
  CXCR4 targeting guide RNA
ucuagcuuuacgugauucacua

SEQ ID NO: 6480 - RNA, 22 nt, Artificial Sequence
  CXCR4 targeting guide RNA
ucuaggcaggaccuguggccaa

SEQ ID NO: 6481 - RNA, 22 nt, Artificial Sequence
  CXCR4 targeting guide RNA
ucuauaccacuuugggcuuugg

SEQ ID NO: 6482 - RNA, 22 nt, Artificial Sequence
  CXCR4 targeting guide RNA
ucuaugcauaaacagcugggga

SEQ ID NO: 6483 - RNA, 22 nt, Artificial Sequence
  CXCR4 targeting guide RNA
ucuccauucccguggaacguuu

SEQ ID NO: 6484 - RNA, 22 nt, Artificial Sequence
  CXCR4 targeting guide RNA
ucucgugguaggacuguagaaa

SEQ ID NO: 6485 - RNA, 22 nt, Artificial Sequence
  CXCR4 targeting guide RNA
ucucuccauucccguggaacgu

SEQ ID NO: 6486 - RNA, 22 nt, Artificial Sequence
  CXCR4 targeting guide RNA
ucuggaauguucaguucccuuu

SEQ ID NO: 6487 - RNA, 22 nt, Artificial Sequence
  CXCR4 targeting guide RNA
ucuuaagaacaggaaaaacguu

SEQ ID NO: 6488 - RNA, 22 nt, Artificial Sequence
  CXCR4 targeting guide RNA
ucuuaagacgugauuuugcugu

SEQ ID NO: 6489 - RNA, 22 nt, Artificial Sequence
  CXCR4 targeting guide RNA
ucuuaguugcuguaugucucgu

SEQ ID NO: 6490 - RNA, 22 nt, Artificial Sequence
  CXCR4 targeting guide RNA
ucuucuacagcaaaaucacguc

SEQ ID NO: 6491 - RNA, 22 nt, Artificial Sequence
  CXCR4 targeting guide RNA
ugaaaaaccagcauuucuauac

SEQ ID NO: 6492 - RNA, 22 nt, Artificial Sequence
  CXCR4 targeting guide RNA
ugaaaacugaaaaaccagcauu

SEQ ID NO: 6493 - RNA, 22 nt, Artificial Sequence
  CXCR4 targeting guide RNA
ugaaaucaacccacuccugaaa

SEQ ID NO: 6494 - RNA, 22 nt, Artificial Sequence
  CXCR4 targeting guide RNA
ugaacauuccagagcguguagu

SEQ ID NO: 6495 - RNA, 22 nt, Artificial Sequence
  CXCR4 targeting guide RNA
ugaaucacguaaagcuagaaau

SEQ ID NO: 6496 - RNA, 22 nt, Artificial Sequence
  CXCR4 targeting guide RNA
ugauccccagcuguuuaugcau

SEQ ID NO: 6497 - RNA, 22 nt, Artificial Sequence
  CXCR4 targeting guide RNA
ugaugugugucuaggcaggacc

SEQ ID NO: 6498 - RNA, 22 nt, Artificial Sequence
  CXCR4 targeting guide RNA
ugauucacuacacgcucuggaa

SEQ ID NO: 6499 - RNA, 22 nt, Artificial Sequence
  CXCR4 targeting guide RNA
ugauuucagcaccuacagugua

SEQ ID NO: 6500 - RNA, 22 nt, Artificial Sequence
  CXCR4 targeting guide RNA
ugauuuugcuguagaagauggc

SEQ ID NO: 6501 - RNA, 22 nt, Artificial Sequence
  CXCR4 targeting guide RNA
ugcauaaacagcuggggaucau

SEQ ID NO: 6502 - RNA, 22 nt, Artificial Sequence
  CXCR4 targeting guide RNA
ugcauagauaaucucuccauuc

SEQ ID NO: 6503 - RNA, 22 nt, Artificial Sequence
  CXCR4 targeting guide RNA
ugccaucuucuacagcaaaauc

SEQ ID NO: 6504 - RNA, 22 nt, Artificial Sequence
  CXCR4 targeting guide RNA
ugccuagacacacaucaauaug

SEQ ID NO: 6505 - RNA, 22 nt, Artificial Sequence
  CXCR4 targeting guide RNA
ugcugaaaucaacccacuccug

SEQ ID NO: 6506 - RNA, 22 nt, Artificial Sequence
  CXCR4 targeting guide RNA
ugcugguuuuucaguuuucagg

SEQ ID NO: 6507 - RNA, 22 nt, Artificial Sequence
  CXCR4 targeting guide RNA
ugcuguagaagauggcacuuau

SEQ ID NO: 6508 - RNA, 22 nt, Artificial Sequence
  CXCR4 targeting guide RNA
ugcuguaugucucgugguagga

SEQ ID NO: 6509 - RNA, 22 nt, Artificial Sequence
  CXCR4 targeting guide RNA
ugcuuguuggauuuuugucuug

SEQ ID NO: 6510 - RNA, 22 nt, Artificial Sequence
  CXCR4 targeting guide RNA
uggaacguuuuuccuguucuua

SEQ ID NO: 6511 - RNA, 22 nt, Artificial Sequence
  CXCR4 targeting guide RNA
uggaauguucaguucccuuuuc

SEQ ID NO: 6512 - RNA, 22 nt, Artificial Sequence
  CXCR4 targeting guide RNA
uggagagauuaucuaugcauaa

SEQ ID NO: 6513 - RNA, 22 nt, Artificial Sequence
  CXCR4 targeting guide RNA
uggauuuuugucuuguguuucu

SEQ ID NO: 6514 - RNA, 22 nt, Artificial Sequence
  CXCR4 targeting guide RNA
uggcacuuauaaccaaagccca

SEQ ID NO: 6515 - RNA, 22 nt, Artificial Sequence
  CXCR4 targeting guide RNA
uggccaaguucuuaguugcugu

SEQ ID NO: 6516 - RNA, 22 nt, Artificial Sequence
  CXCR4 targeting guide RNA
uggccacagguccugccuagac

SEQ ID NO: 6517 - RNA, 22 nt, Artificial Sequence
  CXCR4 targeting guide RNA
ugggcuuugguuauaagugcca

SEQ ID NO: 6518 - RNA, 22 nt, Artificial Sequence
  CXCR4 targeting guide RNA
uggggaucauuucuagcuuuac

SEQ ID NO: 6519 - RNA, 22 nt, Artificial Sequence
  CXCR4 targeting guide RNA
uggguugauuucagcaccuaca

SEQ ID NO: 6520 - RNA, 22 nt, Artificial Sequence
  CXCR4 targeting guide RNA
ugguaggacuguagaaaaggga

SEQ ID NO: 6521 - RNA, 22 nt, Artificial Sequence
  CXCR4 targeting guide RNA
ugguauagaaaugcugguuuuu

SEQ ID NO: 6522 - RNA, 22 nt, Artificial Sequence
  CXCR4 targeting guide RNA
uggucagucuuuuauaucugaa

SEQ ID NO: 6523 - RNA, 22 nt, Artificial Sequence
  CXCR4 targeting guide RNA
ugguuauaagugccaucuucua

SEQ ID NO: 6524 - RNA, 22 nt, Artificial Sequence
  CXCR4 targeting guide RNA
ugguuuuucaguuuucaggagu

SEQ ID NO: 6525 - RNA, 22 nt, Artificial Sequence
  CXCR4 targeting guide RNA
uguacaauauuggucagucuuu

SEQ ID NO: 6526 - RNA, 22 nt, Artificial Sequence
  CXCR4 targeting guide RNA
uguacacuguaggugcugaaau

SEQ ID NO: 6527 - RNA, 22 nt, Artificial Sequence
  CXCR4 targeting guide RNA
uguacagucuuguauuaaguug

SEQ ID NO: 6528 - RNA, 22 nt, Artificial Sequence
  CXCR4 targeting guide RNA
uguagaaaagggaacugaacau

SEQ ID NO: 6529 - RNA, 22 nt, Artificial Sequence
  CXCR4 targeting guide RNA
uguagaagauggcacuuauaac

SEQ ID NO: 6530 - RNA, 22 nt, Artificial Sequence
  CXCR4 targeting guide RNA
uguaggugcugaaaucaaccca

SEQ ID NO: 6531 - RNA, 22 nt, Artificial Sequence
  CXCR4 targeting guide RNA
uguagugaaucacguaaagcua

SEQ ID NO: 6532 - RNA, 22 nt, Artificial Sequence
  CXCR4 targeting guide RNA
uguaugucucgugguaggacug

SEQ ID NO: 6533 - RNA, 22 nt, Artificial Sequence
  CXCR4 targeting guide RNA
ugucuaggcaggaccuguggcc

SEQ ID NO: 6534 - RNA, 22 nt, Artificial Sequence
  CXCR4 targeting guide RNA
ugucucgugguaggacuguaga

SEQ ID NO: 6535 - RNA, 22 nt, Artificial Sequence
  CXCR4 targeting guide RNA
uguggccaaguucuuaguugcu

SEQ ID NO: 6536 - RNA, 22 nt, Artificial Sequence
  CXCR4 targeting guide RNA
ugugucuaggcaggaccugugg

SEQ ID NO: 6537 - RNA, 22 nt, Artificial Sequence
  CXCR4 targeting guide RNA
ugugugucuaggcaggaccugu

SEQ ID NO: 6538 - RNA, 22 nt, Artificial Sequence
  CXCR4 targeting guide RNA
uguucaguucccuuuucuacag

SEQ ID NO: 6539 - RNA, 22 nt, Artificial Sequence
  CXCR4 targeting guide RNA
uguucuuaagacgugauuuugc

SEQ ID NO: 6540 - RNA, 22 nt, Artificial Sequence
  CXCR4 targeting guide RNA
uguuggauuuuugucuuguguu

SEQ ID NO: 6541 - RNA, 22 nt, Artificial Sequence
  CXCR4 targeting guide RNA
uguuucauauugaugugugucu

SEQ ID NO: 6542 - RNA, 22 nt, Artificial Sequence
  CXCR4 targeting guide RNA
uuaagaacaggaaaaacguucc

SEQ ID NO: 6543 - RNA, 22 nt, Artificial Sequence
  CXCR4 targeting guide RNA
uuaagacgugauuuugcuguag

SEQ ID NO: 6544 - RNA, 22 nt, Artificial Sequence
  CXCR4 targeting guide RNA
uuaauacaagacuguacacugu

SEQ ID NO: 6545 - RNA, 22 nt, Artificial Sequence
  CXCR4 targeting guide RNA
uuacgugauucacuacacgcuc

SEQ ID NO: 6546 - RNA, 22 nt, Artificial Sequence
  CXCR4 targeting guide RNA
uuaguugcuguaugucucgugg

SEQ ID NO: 6547 - RNA, 22 nt, Artificial Sequence
  CXCR4 targeting guide RNA
uuauaaccaaagcccaaagugg

SEQ ID NO: 6548 - RNA, 22 nt, Artificial Sequence
  CXCR4 targeting guide RNA
uuauaagugccaucuucuacag

SEQ ID NO: 6549 - RNA, 22 nt, Artificial Sequence
  CXCR4 targeting guide RNA
uuaucuaugcauaaacagcugg

SEQ ID NO: 6550 - RNA, 22 nt, Artificial Sequence
  CXCR4 targeting guide RNA
uuaugcauagauaaucucucca

SEQ ID NO: 6551 - RNA, 22 nt, Artificial Sequence
  CXCR4 targeting guide RNA
uucacuacacgcucuggaaugu

SEQ ID NO: 6552 - RNA, 22 nt, Artificial Sequence
  CXCR4 targeting guide RNA
uucagauauaaaagacugacca

SEQ ID NO: 6553 - RNA, 22 nt, Artificial Sequence
  CXCR4 targeting guide RNA
uucagcaccuacaguguacagu

SEQ ID NO: 6554 - RNA, 22 nt, Artificial Sequence
  CXCR4 targeting guide RNA
uucaggaguggguugauuucag

SEQ ID NO: 6555 - RNA, 22 nt, Artificial Sequence
  CXCR4 targeting guide RNA
uucaguucccuuuucuacaguc

SEQ ID NO: 6556 - RNA, 22 nt, Artificial Sequence
  CXCR4 targeting guide RNA
uucaguuuucaggaguggguug

SEQ ID NO: 6557 - RNA, 22 nt, Artificial Sequence
  CXCR4 targeting guide RNA
uucauauugaugugugucuagg

SEQ ID NO: 6558 - RNA, 22 nt, Artificial Sequence
  CXCR4 targeting guide RNA
uuccacgggaauggagagauua

SEQ ID NO: 6559 - RNA, 22 nt, Artificial Sequence
  CXCR4 targeting guide RNA
uuccagagcguguagugaauca

SEQ ID NO: 6560 - RNA, 22 nt, Artificial Sequence
  CXCR4 targeting guide RNA
uucccguggaacguuuuuccug

SEQ ID NO: 6561 - RNA, 22 nt, Artificial Sequence
  CXCR4 targeting guide RNA
uucccuuuucuacaguccuacc

SEQ ID NO: 6562 - RNA, 22 nt, Artificial Sequence
  CXCR4 targeting guide RNA
uuccuguucuuaagacgugauu

SEQ ID NO: 6563 - RNA, 22 nt, Artificial Sequence
  CXCR4 targeting guide RNA
uucuacagcaaaaucacgucuu

SEQ ID NO: 6564 - RNA, 22 nt, Artificial Sequence
  CXCR4 targeting guide RNA
uucuacaguccuaccacgagac

SEQ ID NO: 6565 - RNA, 22 nt, Artificial Sequence
  CXCR4 targeting guide RNA
uucuagcuuuacgugauucacu

SEQ ID NO: 6566 - RNA, 22 nt, Artificial Sequence
  CXCR4 targeting guide RNA
uucuauaccacuuugggcuuug

SEQ ID NO: 6567 - RNA, 22 nt, Artificial Sequence
  CXCR4 targeting guide RNA
uucuuaagacgugauuuugcug

SEQ ID NO: 6568 - RNA, 22 nt, Artificial Sequence
  CXCR4 targeting guide RNA
uucuuaguugcuguaugucucg

SEQ ID NO: 6569 - RNA, 22 nt, Artificial Sequence
  CXCR4 targeting guide RNA
uugaugugugucuaggcaggac

SEQ ID NO: 6570 - RNA, 22 nt, Artificial Sequence
  CXCR4 targeting guide RNA
uugauuucagcaccuacagugu

SEQ ID NO: 6571 - RNA, 22 nt, Artificial Sequence
  CXCR4 targeting guide RNA
uugcuguagaagauggcacuua

SEQ ID NO: 6572 - RNA, 22 nt, Artificial Sequence
  CXCR4 targeting guide RNA
uugcuguaugucucgugguagg

SEQ ID NO: 6573 - RNA, 22 nt, Artificial Sequence
  CXCR4 targeting guide RNA
uugcuuguuggauuuuugucuu

SEQ ID NO: 6574 - RNA, 22 nt, Artificial Sequence
  CXCR4 targeting guide RNA
uuggauuuuugucuuguguuuc

SEQ ID NO: 6575 - RNA, 22 nt, Artificial Sequence
  CXCR4 targeting guide RNA
uuggccacagguccugccuaga

SEQ ID NO: 6576 - RNA, 22 nt, Artificial Sequence
  CXCR4 targeting guide RNA
uugggcuuugguuauaagugcc

SEQ ID NO: 6577 - RNA, 22 nt, Artificial Sequence
  CXCR4 targeting guide RNA
uuggucagucuuuuauaucuga

SEQ ID NO: 6578 - RNA, 22 nt, Artificial Sequence
  CXCR4 targeting guide RNA
uugguuauaagugccaucuucu

SEQ ID NO: 6579 - RNA, 22 nt, Artificial Sequence
  CXCR4 targeting guide RNA
uuguuggauuuuugucuugugu

SEQ ID NO: 6580 - RNA, 22 nt, Artificial Sequence
  CXCR4 targeting guide RNA
uuguuucauauugauguguguc

SEQ ID NO: 6581 - RNA, 22 nt, Artificial Sequence
  CXCR4 targeting guide RNA
uuuacgugauucacuacacgcu

SEQ ID NO: 6582 - RNA, 22 nt, Artificial Sequence
  CXCR4 targeting guide RNA
uuuaugcauagauaaucucucc

SEQ ID NO: 6583 - RNA, 22 nt, Artificial Sequence
  CXCR4 targeting guide RNA
uuucagauauaaaagacugacc

SEQ ID NO: 6584 - RNA, 22 nt, Artificial Sequence
  CXCR4 targeting guide RNA
uuucagcaccuacaguguacag

SEQ ID NO: 6585 - RNA, 22 nt, Artificial Sequence
  CXCR4 targeting guide RNA
uuucaggaguggguugauuuca

SEQ ID NO: 6586 - RNA, 22 nt, Artificial Sequence
  CXCR4 targeting guide RNA
uuucaguuuucaggaguggguu

SEQ ID NO: 6587 - RNA, 22 nt, Artificial Sequence
  CXCR4 targeting guide RNA
uuucauauugaugugugucuag

SEQ ID NO: 6588 - RNA, 22 nt, Artificial Sequence
  CXCR4 targeting guide RNA
uuuccuguucuuaagacgugau

SEQ ID NO: 6589 - RNA, 22 nt, Artificial Sequence
  CXCR4 targeting guide RNA
uuucuacaguccuaccacgaga

SEQ ID NO: 6590 - RNA, 22 nt, Artificial Sequence
  CXCR4 targeting guide RNA
uuucuagcuuuacgugauucac

SEQ ID NO: 6591 - RNA, 22 nt, Artificial Sequence
  CXCR4 targeting guide RNA
uuucuauaccacuuugggcuuu

SEQ ID NO: 6592 - RNA, 22 nt, Artificial Sequence
  CXCR4 targeting guide RNA
uuugcuguagaagauggcacuu

SEQ ID NO: 6593 - RNA, 22 nt, Artificial Sequence
  CXCR4 targeting guide RNA
uuugggcuuugguuauaagugc

SEQ ID NO: 6594 - RNA, 22 nt, Artificial Sequence
  CXCR4 targeting guide RNA
uuugguuauaagugccaucuuc

SEQ ID NO: 6595 - RNA, 22 nt, Artificial Sequence
  CXCR4 targeting guide RNA
uuuucaggaguggguugauuuc

SEQ ID NO: 6596 - RNA, 22 nt, Artificial Sequence
  CXCR4 targeting guide RNA
uuuucaguuuucaggagugggu

SEQ ID NO: 6597 - RNA, 22 nt, Artificial Sequence
  CXCR4 targeting guide RNA
uuuuccuguucuuaagacguga

SEQ ID NO: 6598 - RNA, 22 nt, Artificial Sequence
  CXCR4 targeting guide RNA
uuuucuacaguccuaccacgag

SEQ ID NO: 6599 - RNA, 22 nt, Artificial Sequence
  CXCR4 targeting guide RNA
uuuugcuguagaagauggcacu

SEQ ID NO: 6600 - RNA, 22 nt, Artificial Sequence
  CXCR4 targeting guide RNA
uuuuucaguuuucaggaguggg

SEQ ID NO: 6601 - RNA, 22 nt, Artificial Sequence
  CXCR4 targeting guide RNA
uuuuuccuguucuuaagacgug

SEQ ID NO: 6602 - RNA, 20 nt, Artificial Sequence
  Guide RNA
aagcauuaacccaguuaaaa

SEQ ID NO: 6603 - RNA, 17 nt, Artificial Sequence
  17 nucleotide guide sequence 1
cauuaacccaguuaaaa

SEQ ID NO: 6604 - RNA, 17 nt, Artificial Sequence
  17 nucleotide guide sequence 2
gcauuaacccaguuaaa

SEQ ID NO: 6605 - RNA, 17 nt, Artificial Sequence
  17 nucleotide guide sequence 3
agcauuaacccaguuaa

SEQ ID NO: 6606 - RNA, 17 nt, Artificial Sequence
  17 nucleotide guide sequence 4
aagcauuaacccaguua

The invention claimed is:

1. A method for modifying a mutant allele of the CXCR4 gene having a mutation associated with wart, hypogammaglobulinemia, infection, and myelokathexis (WHIM) syndrome in a cell without knocking out the expression of a functional CXCR4 protein encoded by a functional allele of the CXCR4 gene, the method comprising introducing to the cell a composition comprising:

a CRISPR nuclease, and a first RNA molecule comprising a guide sequence portion having 17-25 nucleotides, and a second RNA molecule comprising a non-discriminatory guide sequence portion having 17-25 nucleotides, wherein a complex of the CRISPR nuclease and the first RNA molecule affects a double strand break in the mutant allele of the CXCR4 gene but not the functional CXCR4 allele, 8. The method of claim 1, wherein the first RNA molecule further comprises a guide sequence portion comprising 17-22 continuous nucleotides containing nucleotides in the sequence set forth in SEQ ID NO: 3815.

9. The method of claim 8, wherein a portion of the CXCR4 mutant allele is excised by the first and second RNA molecules.

10. The method of claim 8, wherein the guide sequence portion of the second RNA molecule comprises 17-25 contiguous nucleotides containing nucleotides in the sequence set forth in any one of SEQ ID NOs: 4629-6601.

11. The method of claim 8, wherein the guide sequence portion of the second RNA molecule comprises 17-22 contiguous nucleotides containing nucleotides in the sequence set forth in SEQ ID NO: 4629-6601.

12. The method of claim 8, wherein the second RNA molecule comprises a guide sequence portion that targets a sequence up to 500 basepairs from a CXCR4 polyadenylation sequence.

* * * * *